(12) United States Patent
Cochu-Blachere et al.

(10) Patent No.: US 11,725,199 B2
(45) Date of Patent: *Aug. 15, 2023

(54) LACTIC ACID BACTERIA WITH SWEETENING PROPERTIES AND USES THEREOF

(71) Applicant: DUPONT NUTRITION BIOSCIENCES APS, Copenhagen (DK)

(72) Inventors: Armelle Cochu-Blachere, Naintré (FR); Christophe Fremaux, Poitiers (FR); Thomas Desfougeres, Dange-Saint-Romain (FR)

(73) Assignee: DUPONT NUTRITION BIOSCIENCES APS, Kongens Lyngby (DK)

( * ) Notice: Subject to any disclaimer, the term of this patent is extended or adjusted under 35 U.S.C. 154(b) by 187 days.

This patent is subject to a terminal disclaimer.

(21) Appl. No.: 16/956,568

(22) PCT Filed: Dec. 21, 2018

(86) PCT No.: PCT/EP2018/086668
§ 371 (c)(1),
(2) Date: Jun. 20, 2020

(87) PCT Pub. No.: WO2019/122365
PCT Pub. Date: Jun. 27, 2019

(65) Prior Publication Data
US 2021/0040471 A1    Feb. 11, 2021

(30) Foreign Application Priority Data
Dec. 22, 2017  (EP) ..................... 17210053

(51) Int. Cl.
| | | |
|---|---|---|
| C12N 1/20 | (2006.01) | |
| C12R 1/46 | (2006.01) | |
| C12N 15/01 | (2006.01) | |
| A23C 9/123 | (2006.01) | |
| C12N 9/12 | (2006.01) | |

(52) U.S. Cl.
CPC ............ C12N 15/01 (2013.01); A23C 9/1238 (2013.01); C12N 1/205 (2021.05); C12N 9/1205 (2013.01); *A23Y 2240/75* (2013.01); *C12R 2001/46* (2021.05); *C12Y 207/01002* (2013.01)

(58) Field of Classification Search
CPC .................. C12N 1/205; C12Y 207/01002
See application file for complete search history.

(56) References Cited

FOREIGN PATENT DOCUMENTS

| | | |
|---|---|---|
| WO | 2013160413 A1 | 10/2013 |
| WO | 2015014940 A1 | 2/2015 |
| WO | 2015140211 A1 | 9/2015 |
| WO | 2017103051 A1 | 6/2017 |
| WO | 2017167660 A1 | 10/2017 |

OTHER PUBLICATIONS

Vaillancourt et al., Journal of Bacteriology Feb. 18, 20024(3):785-93 (Year: 2002).*
Vin et al., "Molecular and Biochemical Analysis of the Galactose Phenotype of Dairy *Streptococcus thermophilus* Strains Reveals Four Different Fermentation Profiles" Appl Environ Microbiol. Jul. 2005; 71(7): 3659-3667 (Year: 2005).*
U.S. Appl. No. 17/415,964 (Year: 2018).*
Van Den Bogaard, et al., "Control of Lactose Transport, β-Galactosidase Activity, and Glycolysis by CcpA in *Streptococcus thermophilus*: Evidence for Carbon Catabolite Repression by a Non-Phosphoenolpyruvate-Dependent Phosphotransferase System Sugar", J. Bacteriology, vol. 182, No. 21, pp. 5982-5989 (Nov. 2000).
Thompson, et al., "Lactose Metabolism in *Streptococcus lactis*: Studies with a Mutant Lacking Glucokinase and Mannose-Phosphotransferase Activities", J. Bacteriology, vol. 162, No. 1 (Apr. 1985).
Sorensen, et al., "Enhancing the Sweetness of Yoghurt through Metabolic Remodeling of Carbohydrate Metabolism in *Streptococcus thermophilus* and *Lactobacillus delbrueckii* subsp. *Bulgaricus*", J. Appl. and Environmental Microbiology, vol. 82, No. 12, pp. 3683-3692 (Jun. 2016).
Pool, et al., "Natural sweetening of food products by engineering Lactococcus lactis for glucose production", Metabolic Engineering, vol. 8, pp. 456-464 (2006).
Pachekrepapol, et al., "Characterization of the chemical structures and physical properties of exopolysaccharides produced by various *Streptococcus thermophilus* strains", J. Dairy Sci., vol. 100, pp. 3424-3435 (2017).
International Search Report and Written Opinion dated Apr. 3, 2019 for PCT/EP2018/086668.
International Preliminary Report dated Jul. 2, 2020 for PCT/EP2018/086668.
Bergsveinson, "Dissolved carbon dioxide selects for lactic acid bacteria able to grow in and spoil packaged beer", J.Am.Soc.Brew. Chem. XP-002780386 (2017).
UniProtKB, AOA1QFE46, Glucokinase, EMBL: OLF69794.1, Apr. 12, 2017, 2 pages.

* cited by examiner

*Primary Examiner* — Ruth A Davis

(57) ABSTRACT

The invention is directed to a lactose-positive, galactose-negative, *Streptococcus thermophilus* strain releasing glucose during milk fermentation. This *Streptococcus thermophilus* strain carries mutation in the glcK gene, in the ccpA gene, in the lacZ gene and/or in the ptsH gene, and optionally in one or more genes, in particular one gene, encoding a protein of the mannose-glucose-specific PTS. The invention also concerns a composition comprising at least one, lactose-positive, galactose-negative, *Streptococcus thermophilus* strain of the invention, and the use of this strain or composition to manufacture a fermented dairy product.

14 Claims, 3 Drawing Sheets

Specification includes a Sequence Listing.

```
DGCC7710       MSKKLLGIDLGGTTVKFGILTADGEVQEKWAIETNTFENGSHIVPDIVESLKHRLELYG
DSM32587       MSKKLLGIDLGGTTVKFGILTADGEVQEKWAIETNTFENGSHIVPDIVESLKHRLELYG
ST1m-glcK0-gal+ MSKKLLGIDLGGTTVKFGILTADGEVQEKWAIETNTFENGSHIVPDIVESLKHRLELYG LTAEDFIGIGMGSPGAVDRENKTVTGAFNLNWAETQEVGSVIEKELGIPFAIDNDANVAALGERWVGAGAN
LTAEDFIGIGMGSPGAVDRENKTVTGAFNLNWAETQEVGSVIEKELGIPFAIDNDANVAALGERWVGAGAN
LTAEDFIGIGMG[P]PGAVDRENKTVTGAFNLNWAETQEVGSVIEKELGIPFAIDNDANVAALGERWVGAGAN NRNVVFITLGTGVGGGVIADGNLIHGVAGAGGEIGHIIVEPDTGFECTCGNKGCLETVASATGIVRVAHH
NRNVVFITLGTGVGGGVIADGNLIHGVAGAGGEIGHIIVEPDTGFECTCGNKGCLETVASATGIVRVAHH
NRNVVFITLGTGVGGGVIADGNLIHGVAGAGGEIGHIIVEPDTGFECTCGNKGCLETVASATGIVRVAHH LAEKYEGNSSIKAAVDNGEFVTSKDIIVAATEGDKFADSIVDKVSKYLGLATANISNILNPDSVVIGGGV
LAEKYEGNSSIKAAVDNGEFVTSKDIIVAATEGDKFADSIVDKVSKYLGLATANISNILNPDSVVIGGGV
LAEKYEGNSSIKAAVDNGEFVTSKDIIVAATEGDKFADSIVDKVSKYLGLATANISNILNPDSVVIGGGV SAAGEFLRSRVEGYFTRYAFPQVRRTTKVKLAELGNDAGIIGAASLAYSIDK
SAAG[K]FLRSRVEGYFTRYAFPQVRRTTKVKLAELGNDAGIIGAASLAYSIDK
SAAGEFLRSRVEGYFTRYAFPQVRRTTKVKLAELGNDAGIIGAASLAYSIDK
```

FIG. 1

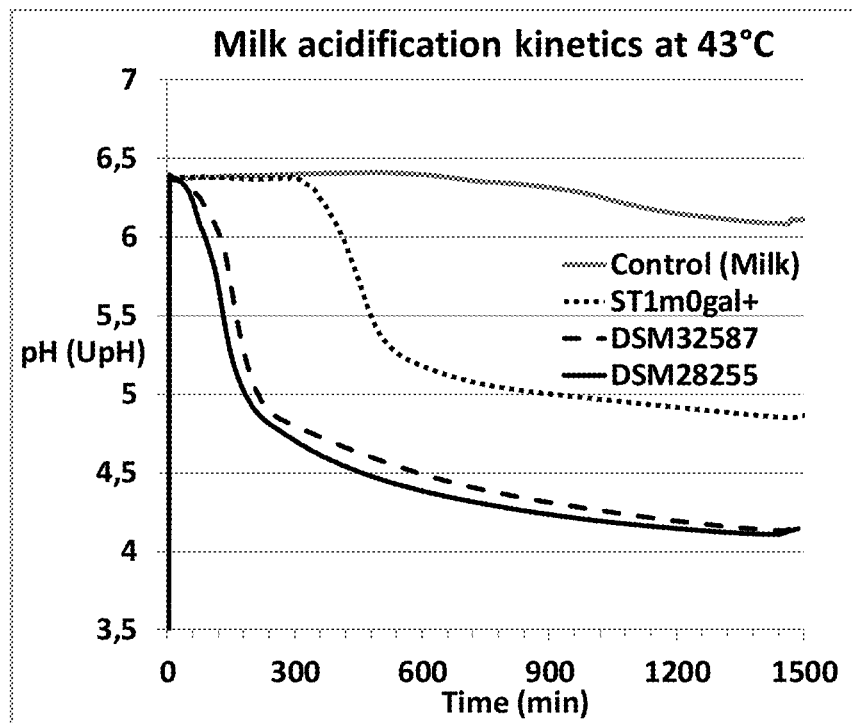

FIG. 2

A.
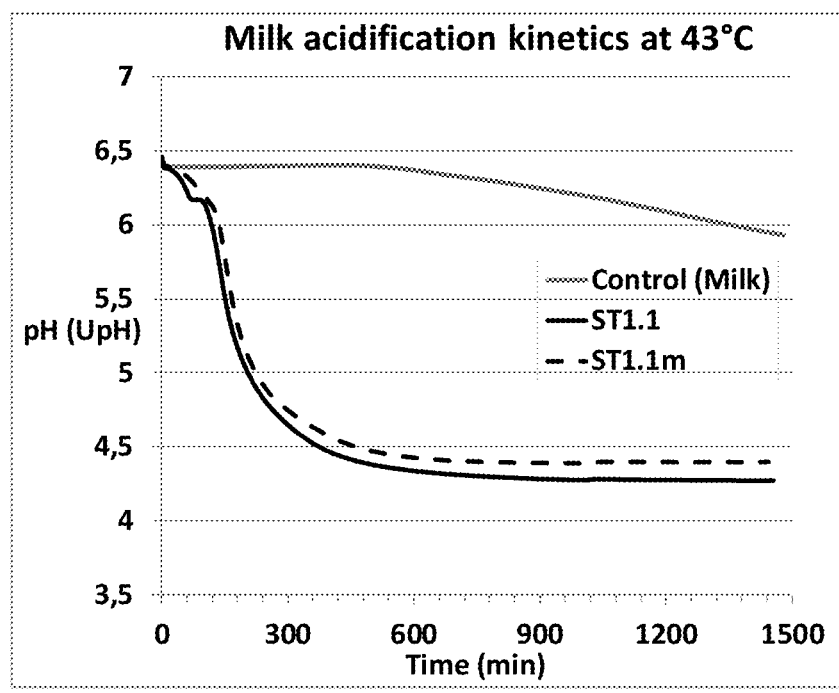
B.
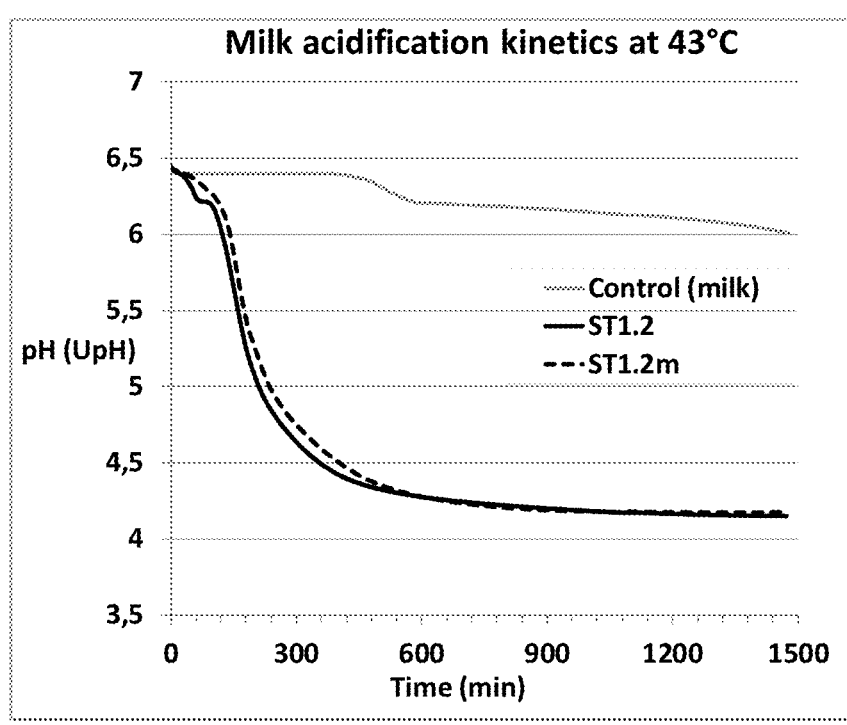
FIG. 3

LACTIC ACID BACTERIA WITH SWEETENING PROPERTIES AND USES THEREOF

CROSS REFERENCE TO RELATED PATENT APPLICATIONS

This specification claims priority under 35 USC X371 as a national phase of Int'l Patent Appl. PCT/EP2018/086668 (filed Dec. 21, 2018; and published Jun. 27, 2019 as Int'l Publ. No. WO2019/122365), which, in turn, claims priority to European Patent Appl. No. 17210053.9 (filed Dec. 22, 2017). The entire text of each of the above-referenced patent applications is incorporated by reference into this specification.

FIELD OF THE INVENTION

The invention is directed to a lactose-positive, galactose-negative, *Streptococcus thermophilus* strain releasing glucose during milk fermentation. This *Streptococcus thermophilus* strain carries mutation in the glcK gene encoding a glucokinase, the glucokinase activity of which in said strain is significantly reduced but not null, and optionally wherein the maximum forward velocity (Vmax) of its glucokinase in said strain is significantly reduced but not null, in the ccpA gene, in the lacZ gene and/or in the ptsH gene. This strain can additionally carry a mutation in one or more genes, in particular one gene, encoding a protein of the mannose-glucose-specific PTS. The invention also concerns a composition comprising at least one, lactose-positive, galactose-negative, *Streptococcus thermophilus* strain of the invention, and the use of this strain or composition to manufacture a fermented dairy product.

BACKGROUND TO THE INVENTION

The food industry uses bacteria in order to improve the taste and the texture of food or feed products. In the case of the dairy industry, lactic acid bacteria are commonly used in order to, for example, bring about the acidification of milk (by fermentation of lactose) and to texturize the product into which they are incorporated. For example, the lactic acid bacteria of the species *Streptococcus thermophilus* (*S. thermophilus*) are used extensively, alone or in combination with other bacteria, in the manufacture of fresh fermented dairy products, such as yoghurt. The term "yoghurt" is defined according to French and European regulations, i.e., coagulated dairy products obtained by lactic acid fermentation with *Streptococcus thermophilus* and *Lactobacillus delbrueckii* subsp. *bulgaricus* Lb. *bulgaricus*).

Because of the consumers taste, fresh fermented dairy products are often sweetened by the addition of fruit, sugar or sweeteners. Thus, artificial or natural sweeteners are normally added to enhance the sweet properties of final fresh fermented dairy products. However, at the same time, there is a growing demand for healthier products where no additives are added to the final product.

There is therefore a need for process of manufacture of sweet fresh fermented dairy products using less or no additive. Solutions—based on strains naturally producing glucose—have been recently discussed or proposed.

Pool et al. (2006. Metabolic Engineering 8(5); 456-464) discuss the natural sweetening of food products by engineering *Lactococcus lactis* (*L. lactis*) for glucose production. Thus, Pool et al disclose a *Lactococcus lactis* strain in which the glucose metabolism is completely disrupted by deletion of the glcK gene coding for glucokinase (i.e., no glucokinase activity), of the ptnABCD genes encoding the mannose/glucose-PTS and of the ptcB-ptcA genes encoding the protein complex EIIBA$^{cel}$ of the glucose-PTS EII$^{cel}$. Thus, the obtained strain could solely ferment the galactose moiety of lactose (as a result of *L. lactis* strains being galactose-fermenting strains), while the glucose moiety accumulated extracellularly. However, the *Lactococcus lactis* species is not necessarily suitable for manufacture of all fresh fermented dairy products, and in particular yoghurts (which requires *Streptococcus thermophilus* and *Lactobacillus delbrueckii* subsp. *bulgaricus* strains).

WO2013/160413, WO2017/103051 and Sørensen et al. (2016; Appl Environ Microbiol 82(12):3683-3692) disclose *Streptococcus thermophilus* strains with enhanced properties for natural sweetening of food products. These *Streptococcus thermophilus* strains are galactose-fermenting and carried a mutation in their glcK gene knocking-out the ability to phosphorylate glucose (i.e., these galactose-fermenting *S. thermophilus* strains show no detectable GlcK activity). The galactose-fermenting phenotype is obtained by a mutation in the promoter region of the galactose operon (upstream of the galK gene) that is known to encode the GalK, GalT, GalE and GalM enzymes. The amino acid changes leading to a GlcK protein with no detectable glucokinase activity are S72P, T141I and G249R. However, these strains are significantly delayed in their acidification kinetics.

Van den Bogaard et al. (Journal of Bacteriology; 2000. 182: 5982-5989) discloses the knock-out (total disruption) of the ccpA gene in *Streptococcus thermophilus*. However, such mutant, though it releases glucose (13 mM) during growth on M17 supplemented with Lactose (20 mM), is significantly delayed in its acidification kinetics (prolonged lag time and reduced growth rate), rendering it not usable at an industrial scale.

WO2015/0149940 (Tine S A) discloses a method to identify glucose secreting lactic acid bacteria by carrying out random mutagenesis at large scale and detecting glucose by enzymatic means on lactose-positive mutants. However, Tine is silent about the nature and the number of mutation(s) and/or gene(s) impacted by the method. In the example part, the mutants obtained are galactose-positive strains, as reported on example 1 (selection of the *S. thermophilus* strains on M17 agar plate supplemented with galactose).

There is therefore a remaining need for strains able to naturally produce glucose, and which can be used at the industrial scale to manufacture fresh fermented dairy products, including yoghurts.

DESCRIPTION OF THE DRAWINGS

FIG. 1: Alignment of the GlcK protein sequence of DGCC7710 (DSM28255), DSM32587 and ST1m-glcK0-gal+ strains. Differences with the GlcK protein of DGCC7710 (SEQ ID NO:2) are boxed.

FIG. 2: Milk acidification curve (pH over time) obtained with DGCC7710, DSM32587 and ST1m-glcK0-gal+ strains.

FIG. 3: Milk acidification curve (pH over time) obtained with (A) the ST1.1 strain and its E275K (ST1.1 m-glcK) mutant, and (B) the ST1.2 strain and its E275K mutant (ST1.2m-glcK).

DETAILED DESCRIPTION

Figure 4:
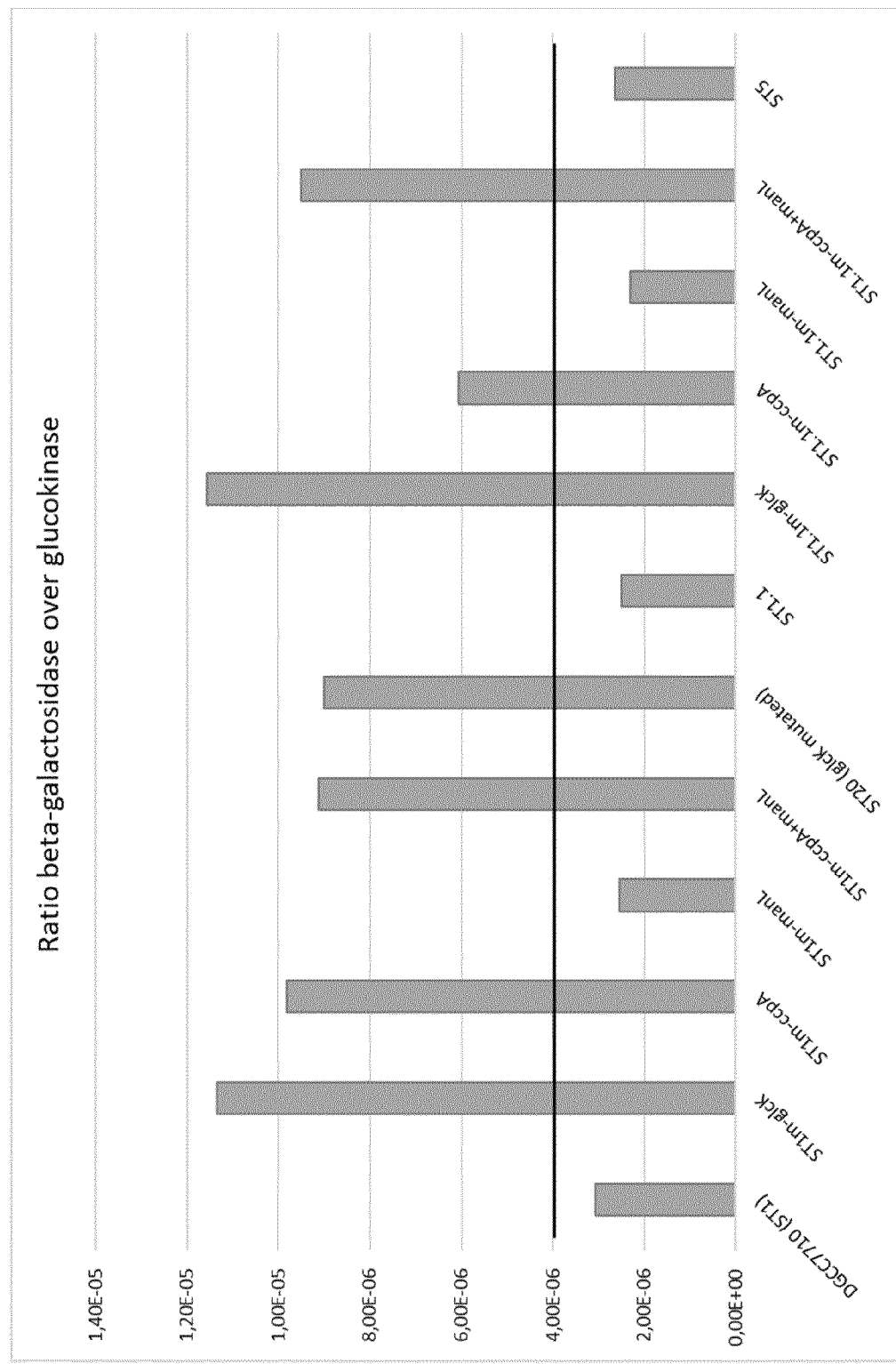
FIG. 4: ratio beta-galactosidase activity as assayed by test D over the glucokinase activity as assayed by test E in various *Streptococcus thermophilus* strains of the invention and their parental strains (control).

The present invention has put in evidence that, more than mutations totally abolishing the function of proteins involved in sugar metabolism (such as ccpA disruption, GlcK protein with no detectable glucokinase activity), mutations tightly deregulating sugar metabolism (and not inhibiting it) can be used to design *Streptococcus thermophilus* strains releasing a significant concentration of glucose during dairy fermentation. The inventors have nicely shown that such *Streptococcus thermophilus* strains can be characterized by the ratio of their beta-galactosidase activity over their glucokinase activity. This ratio translates the behaviour of the lactose-positive, galactose-negative, *Streptococcus thermophilus* strains of the invention with regards to the use of both lactose and glucose during their growth, in particular when used during milk fermentation. Indeed, the beta-galactosidase is responsible for the hydrolysis of lactose into galactose and glucose, whereas the glucokinase makes glucose available for its use through the glycolysis pathway. Thus, the inventors have shown that an increase of the beta-galactosidase activity without any change in the glucokinase activity level [within the ratio mentioned herein] leads to an increase of free glucose, due to an over hydrolysis of lactose. On the other hand, a decrease of the glucokinase activity without any change in the beta-galactosidase activity [within the ratio mentioned herein] has the same metabolic impact. Interestingly, the strains of the invention do not need to be galactose positive (phenotype which has been shown to be unstable in lactose).

Thus, the present invention is directed to a lactose-positive, galactose-negative, *Streptococcus thermophilus* strain, wherein the ratio of the beta-galactosidase activity in said strain as assayed by test D over the glucokinase activity in said strain as assayed by test E is at least $4 \cdot 10^{-6}$, at least $5 \cdot 10^{-6}$, at least $6 \cdot 10^{-6}$, at least $7 \cdot 10^{-6}$ or at least $8 \cdot 10^{-6}$.

The Ratio of the Beta-Galactosidase Activity in Said Strain as Assayed by Test D Over the Glucokinase Activity in Said Strain as Assayed by Test E The lactose-positive, galactose-negative, *Streptococcus thermophilus* strain of the invention exhibits (or has) a ratio of the beta-galactosidase activity in said strain as assayed by test D over the glucokinase activity in said strain as assayed by test E which is at least $4 \cdot 10^{-6}$. In an embodiment, the ratio of the beta-galactosidase activity in said strain as assayed by test D over the glucokinase activity in said strain as assayed by test E is selected from the group consisting of at least $4 \cdot 10^{-6}$, at least $5 \cdot 10^{-6}$, at least $6 \cdot 10^{-6}$, at least $7 \cdot 10^{-6}$ or at least $8 \cdot 10^{-6}$. In an embodiment, the ratio of the beta-galactosidase activity as assayed by test D over the glucokinase as assayed by test E is at least $5 \cdot 10^{-6}$. In an embodiment, the ratio of the beta-galactosidase activity as assayed by test D over the glucokinase as assayed by test E is at least $6 \cdot 10^{-6}$. In an embodiment, the ratio of the beta-galactosidase activity as assayed by test D over the glucokinase as assayed by test E is at least $7 \cdot 10^{-6}$. In an embodiment, the ratio of the beta-galactosidase activity as assayed by test D over the glucokinase as assayed by test E is at least $8 \cdot 10^{-6}$.

Whatever the minimal value of the ratio as defined herein, the ratio of the beta-galactosidase activity as assayed by test D over the glucokinase activity as assayed by test E is less than $8 \cdot 10^{-3}$.

It is noteworthy that the ratio of the beta-galactosidase activity as assayed by test D over the glucokinase activity as assayed by test E as defined herein is not measurable in a *Streptococcus thermophilus* strain, the glucokinase activity of which is null or not detectable by the Test described herein (such as the strains disclosed in Table 1). It is also noteworthy that the ratio of the beta-galactosidase activity as assayed by test D over the glucokinase activity as assayed by test E as defined herein is more than $8 \cdot 10^{-3}$ in *Streptococcus thermophilus* strains, the glucokinase activity of which is drastically reduced. For the avoidance of doubt, these *Streptococcus thermophilus* strains are not part of the invention.

According to the invention, the beta-galactosidase activity in a *Streptococcus thermophilus* strain of the invention is assayed by test D [i.e. the test D is carried out using the *Streptococcus thermophilus* strain of the invention]:

Test D:

A fresh overnight culture of the *Streptococcus thermophilus* strain to be assayed in M17 containing 30 g/L lactose is obtained and used to inoculate at 1% (vol/vol) 10 ml of fresh M17 30 g/L lactose. Cells are harvested by centrifugation (6000 g, 10 min, 4° C.) after 3 hours of growth on M17+30 g/L lactose at 42° C., washed in 1.5 ml cold lysis buffer (KPO4 0.1 M), and resuspended in 300 µl cold lysis buffer. EDTA-free protease inhibitors "cOmplete™" (Roche, supplier reference 04693132001) is added in lysis buffer as described by the provider. Cells are disrupted by the addition of 100 mg glass beads (150-212 µm, Sigma G1145) to 250 µl resuspended cells and oscillation at a frequency of 30 cycles/s for 6 min in a MM200 oscillating mill (Retsch, Haan, Germany). Cell debris and glass beads are removed by centrifugation (14000 g, 15 min, 4° C.), and supernatant transferred into a clean 1.5 mL centrifuge tube kept on ice. Total protein content is determined by using the FLUKA Protein Quantification Kit-Rapid (ref 51254). The beta-galactosidase activity in the cell extracts is determined spectrophotometrically by a monitoring of the hydrolysis of 0-nitro-Phenol-Beta-Glactoside (ONPG) into galactose and O-nitro-phenol (ONP). 20 µL of the bacteria extract are mixed with 135 µL of React Buffer (NaPO$_4$ 0.1 M+KCl 0.01 M+MgSO$_4$ 0.001 M+ONPG 3 mM+Beta Mercapto Ethanol 60 mM, pH=6). The production of ONP leads to a yellow color into the tube. When this color appears, the reaction is block by adding 250 µL of Stopping buffer (Na$_2$CO$_3$ 1 M). The optical density at 420 nm is measured using a Synergy HT multi-detection microplate reader (BIO-TEK). One unit of galactosidase corresponds to the amount of enzyme that catalyzes the production of 1 µmole ONP per minute under the assay conditions. Beta-Galactosidase activity is calculated as follows:

Beta-Galactosidase activity (U/g of total protein extract)= dOD×V/[dt×l×ε×Qprot], wherein:
- dOD is the variation of optical density (OD) at 420 nm between the blank and the tested sample
- V is the volume of the reaction in which the optical density is measured (herein 250 µL)
- dt=represent the duration in minutes between the addition of the 20 µL of bacterial extract and the addition of the 250 µL stopping buffer
- l=optical path length (herein 0.73 cm)
- ε=molar attenuation coefficient of ONP (herein 4500 cm$^2$/µmol)
- Qprot=quantity of protein in the cuvette (in g)

Measurements are at least triplicated for each sample, and the beta-galactosidase specific activity values given herein under test D are the mean of three independent experiments.

According to the invention, for the determination of the ratio as defined herein, the glucokinase activity in a *Streptococcus thermophilus* strain of the invention is assayed by test E [i.e. the test E is carried out using the *Streptococcus thermophilus* strain of the invention].

Test E:

A fresh overnight culture of the *Streptococcus thermophilus* strain to be assayed in M17 containing 30 g/L lactose is obtained and used to inoculate at 1% (vol/vol) 10 ml of fresh M17 30 g/L lactose. Cells are harvested by centrifugation (6000 g, 10 min, 4° C.) after 3 hour of growth on M17+30 g/L lactose at 42° C., washed in 1.5 ml cold GLCK buffer (5 mM MgCl2, 10 mM $K_2HPO_4/KH_2PO_4$ [pH 7.2]), and resuspended in 300 µl cold GLCK buffer. EDTA-free protease inhibitors "cOmplete™" (Roche, supplier reference 04693132001) is added in GLCK buffer as described by the provider. Cells are disrupted by the addition of 100 mg glass beads (150-212 µm, Sigma G1145) to 250 µl resuspended cells and oscillation at a frequency of 30 cycles/s for 6 min in a MM200 oscillating mill (Retsch, Haan, Germany). Cell debris and glass beads are removed by centrifugation (14000 g, 15 min, 4° C.), and supernatant transferred into a clean 1.5 mL centrifuge tube kept on ice. Total protein content is determined by using the FLUKA Protein Quantification Kit-Rapid (ref 51254). The glucokinase activity in the cell extracts is determined spectrophotometrically by a glucose-6-phosphate dehydrogenase (G-6PDH, EC1.1.1.49):NADPH-coupled assay (Porter et al., 1982), essentially as described by Pool et al. (2006). Each sample (5, 10 and 20 µL) is added to assay buffer (10 mM $K_2HPO_4/KH_2PO_4$ [pH 7.2], 5 mM MgCl2, 1 mM ATP, 20 mM glucose, 1 mM NADP, 1 U G-6PDH) in a 250 µL final volume, and the mixture was left for 5 min at 30° C. The optical density at 340 nm is measured for 5 minutes by using a Synergy HT multi-detection microplate reader (BIO-TEK). One unit of glucokinase corresponds to the amount of enzyme that catalyzes the phosphorylation of 1 µmole of D-glucose to D-Glucose 6-phosphate per minute under the assay conditions. Glucokinase activity is calculated as follows:

Glucokinase activity (U/g of total protein extract)=dOD× V/[dt×l×ε×Qprot], wherein:

dOD is the variation of optical density (OD) at 340 nm

V is the volume of the reaction (herein 250 µL)

dt=measurement time (in minutes)

l=optical path length (herein 0.73 cm)

ε=molar attenuation coefficient of NADPH; $H^+$ (herein 6220 cm2/µmol)

Qprot=quantity of protein in the cuvette (in g)

Measurements are triplicated for each sample, and the glucokinase specific activity values given herein under test E are the mean of three independent experiments.

Release of Glucose by the Lactose-Positive, Galactose-Negative, *Streptococcus Thermophilus* Strains of the Invention During Milk Fermentation.

As described herein, the lactose-positive, galactose-negative, *Streptococcus thermophilus* strains of the invention can be further characterized by their ability to release glucose when used to ferment milk. This ability is defined herein by the concentration of glucose which is released into the milk, when the strain of the invention is used to ferment milk. In an embodiment, the fermentation conditions are according to, and the concentration of glucose released is determined by, Test B as defined below:

Test B:

UHT semi-skimmed milk "Le Petit Vendéen ("yoghurt milk") containing 3% (w/v) milk powder (BBA, Lactalis), previously pasteurized 10 min at 90° C., is inoculated at 1% (v/v, about $10^7$ CFU/ml) with a culture of the *S. thermophilus* strain to be assayed (M17-carbohydrate-free resuspended cells from overnight culture grown in M17 supplemented 3% sucrose). This milk is found to contain around 175 mM of lactose. The inoculated milk flasks are statically incubated in a water bath at 43° C. during 24 h, to obtain fermented milk. T0 samples and samples of fermented milk (T24 h) (5 g) are diluted in 25 g 0.025 N $H_2SO_4$, before being centrifuged at 4600 rpm for 10 minutes at 4° C. The supernatant is filtered through a 0.2 µm Nylon filter (Phenomenex, Germany, Aschaffenburg) directly into a 2 ml HPLC vial. Samples are stored at −20° C. until further analysis. Carbohydrates are quantified by high performance liquid chromatography (Agilent 1200 HPLC) equipped with a refractive index detector using an Aminex HPX-87H anion exchange column (Bio-Rad Laboratories Inc.) at 35° C., with 12.5 mM $H_2SO_4$ as the elution fluid and a flow rate of 0.6 ml $min^{-1}$. The exploitation of results is made with Chemstation reprocessing software (Agilent).

For the avoidance of doubt, the *Streptococcus thermophilus* species is to be understood as a *Streptococcus salivarius* subsp. *thermophilus* strain.

By the expression "lactose-positive", it is meant a *Streptococcus thermophilus* strain which is able to grow on lactose as a sole source of carbohydrate source, in particular on a M17 medium supplemented with 2% lactose. In a particular embodiment, the "lactose-positive" phenotype is assayed by inoculating into a M17 broth containing 2% lactose—an overnight culture of the *S. thermophilus* strain to be tested at a rate of 1%, and incubating for 20 hours at 37° C., and wherein a pH of 5.5 or lower at the end of incubation is indicative of a lactose-positive phenotype.

By the expression "galactose-negative", it is meant a *Streptococcus thermophilus* strain which is not able to grow on galactose as a sole source of carbohydrate source, in particular on a M17 medium supplemented with 2% galactose. In a particular embodiment, the "galactose-negative" phenotype is assayed by inoculating into a M17 broth containing 2% galactose—an overnight culture of the *S. thermophilus* strain to be tested at 1% and incubating for 20 hours at 37° C., and wherein a pH of 6 or above at the end of incubation is indicative of a galactose-negative phenotype.

By the expression "derivative" in reference to an original strain (e.g. DGCC7710-derivative), it is meant a strain obtained from an original strain (e.g. from the DGCC7710 strain) by replacement of one of its genes (such as glcK, ccpA, . . . ) by another allele (in particular a mutated allele) of the same gene. In an embodiment, the derivative is obtained by the replacement of the full gene (coding sequence and promoter) of the original strain by another allele (coding sequence and promoter) of the same gene. In an embodiment, the derivative is obtained by the replacement of the coding sequence of a gene of the original strain by another allele (coding sequence) of the same gene.

The present invention is directed to a lactose-positive, galactose-negative, *Streptococcus thermophilus* strain carrying a mutation in one or more gene(s) selected from the group consisting of the glcK gene, the ccpA gene, the lacZ gene, the ptsH gene, and a gene encoding a protein of the mannose-glucose-specific PTS, wherein the ratio of the beta-galactosidase activity in said strain as assayed by test D over the glucokinase activity in said strain as assayed by test E is at least $4·10^{-6}$, is at least $5·10^{-6}$, at least $6·10^{-6}$, at least $7·10^{-6}$ or at least $8·10^{-6}$. In an embodiment, and whatever the minimal value of the ratio as defined herein, the ratio of the beta-galactosidase activity in said strain as assayed by test D over the glucokinase activity in said strain as assayed by test E is less than $8·10^{-3}$.

In an embodiment, the lactose-positive, galactose-negative, *Streptococcus thermophilus* strain of the invention carries mutation(s) in one or more genes selected from the group consisting of the glcK gene, the ccpA gene, the lacZ gene and the ptsH gene, and optionally carrying a mutation in one or more genes, in particular one gene, encoding a protein of the mannose-glucose-specific PTS. In an embodiment, the lactose-positive, galactose-negative, *Streptococcus thermophilus* strain of the invention carries mutation(s) in one or more genes selected from the group consisting of the glcK gene, the ccpA gene, the lacZ gene and the ptsH gene, and carrying a mutation in one or more genes, in particular one gene, encoding a protein of the mannose-glucose-specific PTS. In an embodiment, the lactose-positive, galactose-negative, *Streptococcus thermophilus* strain of the invention carries 1) a mutation in a gene selected from the group consisting of the glcK gene, the ccpA gene, the lacZ gene and the ptsH gene or a mutation in the glcK gene and the ccpA gene, and 2) a mutation in one or more genes, in particular one gene, encoding a protein of the mannose-glucose-specific PTS. In an embodiment, the lactose-positive, galactose-negative, *Streptococcus thermophilus* strain of the invention carries a first mutation in a gene selected from the group consisting of the glcK gene, the ccpA gene, the lacZ gene and the ptsH gene, and a second mutation in a gene encoding a protein of the mannose-glucose-specific PTS.

In an embodiment, the lactose-positive, galactose-negative, *Streptococcus thermophilus* strain of the invention carries a mutation in one or more gene(s) selected from the group consisting of the glcK gene, the ccpA gene and a gene encoding a protein of the mannose-glucose-specific PTS. In an embodiment, the lactose-positive, galactose-negative, *Streptococcus thermophilus* strain of the invention carries a mutation in the glcK gene and/or the ccpA gene and optionally in one or more genes, in particular one gene, encoding a protein of the mannose-glucose-specific PTS.

In any of the embodiments above, the one or more gene(s) encoding a protein of the mannose-glucose-specific PTS is selected from the group consisting of the manL gene, manM gene, manN gene and manO gene. In any of the embodiments above, the one or more gene(s) encoding a protein of the mannose-glucose-specific PTS is selected from the group consisting of the manL gene, manM gene and manN gene. In an embodiment, the lactose-positive, galactose-negative, *Streptococcus thermophilus* strain of the invention carries mutation(s) in a gene or two selected from the group consisting of the glcK gene and the ccpA gene, and a mutation in one or more genes, in particular one gene, encoding a protein of the mannose-glucose-specific PTS. In an embodiment, the lactose-positive, galactose-negative, *Streptococcus thermophilus* strain of the invention carries a mutation in the glcK gene and/or the ccpA gene and optionally in the manL gene, manM gene or manN gene.

Some embodiments of lactose-positive, galactose-negative, *Streptococcus thermophilus* strains of the invention, exhibiting a ratio of the beta-galactosidase activity in said strain as assayed by test D over the glucokinase activity in said strain as assayed by test E of at least $4 \cdot 10^{-6}$, are detailed below:

I. A lactose-positive, galactose-negative, *Streptococcus thermophilus* strain of the invention carrying a mutation in its glcK gene.

II. A lactose-positive, galactose-negative, *Streptococcus thermophilus* strain of the invention carrying a mutation in its ccpA gene.

III. A lactose-positive, galactose-negative, *Streptococcus thermophilus* strain of the invention carrying a mutation in its glcK and a mutation in its ccpA gene.

IV. A lactose-positive, galactose-negative, *Streptococcus thermophilus* strain of the invention carrying a mutation in its lacZ gene.

V. A lactose-positive, galactose-negative, *Streptococcus thermophilus* strain of the invention carrying a mutation in its ptsH gene.

VI. A lactose-positive, galactose-negative, *Streptococcus thermophilus* strain of the invention according to any one of the embodiments I to V, further carrying a mutation in one or more genes, in particular one gene, encoding a protein of the mannose-glucose-specific PTS.

I. A Lactose-Positive, Galactose-Negative, *Streptococcus thermophilus* Strain Carrying a Mutation in its glcK Gene The present invention has put in evidence that *Streptococcus thermophilus* strains, which are galactose-negative and carry a mutation in the glcK gene encoding a glucokinase (GlcK), the glucokinase activity of which in said strain is significantly reduced but not null, can be used to excrete glucose in fermented milk.

The invention is directed to a lactose-positive, galactose-negative, *Streptococcus thermophilus* strain carrying a mutation in the glcK gene encoding a glucokinase, the glucokinase activity of which in said strain is significantly reduced but not null. In an embodiment, the invention is directed to a lactose-positive, galactose-negative, *Streptococcus thermophilus* strain carrying a mutation in the glcK gene encoding a glucokinase, the glucokinase activity of which in said strain is significantly reduced but not null, wherein the ratio of the beta-galactosidase activity in said strain as assayed by test D over the glucokinase activity in said strain as assayed by test E is at least $4 \cdot 10^{-6}$ as defined herein.

The expression "glcK gene encoding a glucokinase" means any DNA sequence of a *Streptococcus thermophilus* strain encoding the glucokinase enzyme which catalyses the conversion of glucose and ATP to glucose-6-phosphate (G6P) and ADP. Non-limitative examples of *Streptococcus thermophilus* glucokinase sequences are disclosed as SEQ ID Nos:2, 4, 6, 8, 10 12, 14, 16, 18 and 20.

Within the invention, the glucokinase activity in a *Streptococcus thermophilus* strain is significantly reduced but not null as a consequence of a mutation in its glcK gene. In other words, the allele of the glcK gene carried by said strain is such that the glucokinase activity in said strain is significantly reduced but not null.

The expression "glucokinase activity in said strain is significantly reduced but not null" refers to a strain the glucokinase activity of which is both:

significantly reduced in said strain, in particular as compared to the glucokinase activity in a strain carrying a non-mutated glcK gene; and not null, i.e., that an activity is detectable by test A as defined herein.

According to the invention, the feature "glucokinase activity in said strain is significantly reduced but not null" can be determined by methods well known in the art. Thus, methods for measuring the glucokinase activity in a *Streptococcus thermophilus* strain are known and include enzyme assays with commercially available reactants. Reference is made herein to the paragraph 2.4 of Pool et al. (2006. Metabolic Engineering 8(5); 456-464) (incorporated herein by reference). In a particular embodiment, for the determination of this feature, the glucokinase activity in a *Strepto-* coccus thermophilus strain of the invention is assayed by test A [i.e. the test A is carried out using the *Streptococcus thermophilus* strain of the invention].

Test A:

A fresh overnight culture of the *Streptococcus thermophilus* strain to be assayed in M17 containing 30 g/L lactose is obtained and used to inoculate at 1% (vol/vol) 10 ml of fresh M17 30 g/L lactose. Cells are harvested by centrifugation (6000 g, 10 min, 4° C.) at a 600 nm optical density (OD600) of 0.8+/−0.2, washed in 5 ml cold GLCK buffer (5 mM MgCl2, 10 mM $K_2HPO_4/KH_2PO_4$ [pH 7.2]), and resuspended in 500 µl cold GLCK buffer. EDTA-free protease inhibitors "cOmplete™" (Roche, supplier reference 04693132001) is added in GLCK buffer as described by the provider. Cells are disrupted by the addition of 100 mg glass beads (150-212 µm, Sigma G1145) to 200 µl resuspended cells and oscillation at a frequency of 30 cycles/s for 6 min in a MM200 oscillating mill (Retsch, Haan, Germany). Cell debris and glass beads are removed by centrifugation (14000 g, 15 min, 4° C.), and supernatant transferred into a clean 1.5 mL centrifuge tube kept on ice. Total protein content is determined by using the FLUKA Protein Quantification Kit-Rapid (ref 51254). The glucokinase activity in the cell extracts is determined spectrophotometrically by a glucose-6-phosphate dehydrogenase (G-6PDH, EC1.1.1.49):NADPH-coupled assay (Porter et al., 1982), essentially as described by Pool et al. (2006). Each sample (5, 10 and 20 µL) is added to assay buffer (10 mM $K_2HPO_4/KH_2PO_4$ [pH 7.2], 5 mM MgCl2, 1 mM ATP, 20 mM glucose, 1 mM NADP, 1 U G-6PDH) in a 250 µL final volume, and the mixture was left for 5 min at 30° C. The optical density at 340 nm is measured for 5 minutes by using a Synergy HT multi-detection microplate reader (BIO-TEK). One unit of glucokinase corresponds to the amount of enzyme that catalyzes the phosphorylation of 1 µmole of D-glucose to D-Glucose 6-phosphate per minute under the assay conditions. Glucokinase activity is calculated as follows:

Glucokinase activity (U/g of total protein extract)=dOD× V/[dt×l×ε×Qprot], wherein:

dOD is the variation of optical density (OD) at 340 nm

V is the volume of the reaction (herein 250 µL)

dt=measurement time (in minutes)

l=optical path length (herein 0.73 cm)

ε=molar attenuation coefficient of NADPH; $H^+$ (herein 6220 cm2/µmol)

Qprot=quantity of protein in the cuvette (in g)

Measurements are triplicated for each sample, and the glucokinase specific activity values given herein under test A are the mean of three independent experiments.

In a first particular embodiment of the feature "glucokinase activity in said strain is significantly reduced but not null", the glucokinase activity in the *Streptococcus thermophilus* strain of the invention is between 200 and 1500 U/g of total protein extract, as assayed by test A. In a particular embodiment, the glucokinase activity in the *Streptococcus thermophilus* strain of the invention is between 300 and 1200 U/g of total protein extract, as assayed by test A. In a particular embodiment, the glucokinase activity in the *Streptococcus thermophilus* strain of the invention is between 400 and 1000 U/g of total protein extract, as assayed by test A. In a particular embodiment, the glucokinase activity in the *Streptococcus thermophilus* strain of the invention is between a minimal value selected from the group consisting of 200, 300 and 400 U/g of total protein extract and a maximal value selected from the group consisting of 1000, 1200 and 1500 U/g of total protein extract, as assayed by test A. It is noteworthy that, as mentioned in test A, the glucokinase activity values disclosed herein are the mean of three independent experiments (triplicates).

In a second particular embodiment of the feature "glucokinase activity in said strain is significantly reduced but not null", the glucokinase activity in the *Streptococcus thermophilus* strain of the invention is between 5 and 60% the activity of the glucokinase activity of the DGCC7710 strain deposited at the DSMZ under accession number DSM28255 on Jan. 14, 2014. By "glucokinase activity of the DGCC7710 strain", it is meant the activity of the DGCC7710 strain glucokinase (i.e., with SEQ ID NO:2) as assayed by test A in the DGCC7710 strain [i.e., the test A is carried out using the DGCC7710 strain]. The percentage value is calculated based on the glucokinase activity in the strain of the invention and the glucokinase activity of the DGCC7710 strain, both assayed by test A. In a particular embodiment, the glucokinase activity in the *Streptococcus thermophilus* strain of the invention is between 10 and 50% the glucokinase activity of the DGCC7710 strain. In a particular embodiment, the glucokinase activity in the *Streptococcus thermophilus* strain of the invention is between 15 and 40% the glucokinase activity of the strain DGCC7710. In a particular embodiment, the glucokinase activity of the *Streptococcus thermophilus* strain of the invention is between a minimal percentage selected from the group consisting of 5, 10 and 15% the glucokinase activity of the DGCC7710 strain and a maximal percentage selected from the group consisting of 40, 50 and 60% the glucokinase activity of the DGCC7710 strain. In a particular embodiment and whatever the range of percentages, the activity of the glucokinase activity is assayed by test A as described herein. It is noteworthy that the percentage values disclosed herein are calculated based on glucokinase activity values which are the mean of three independent experiments (triplicates) as assayed by test A.

In the first and second particular embodiments, the following strains can be used as controls in test A:

as a positive control (i.e., a *Streptococcus thermophilus* strain, which is representative of strains carrying a non-mutated glcK gene): strain DGCC7710 deposited at the DSMZ under accession number DSM28255 on Jan. 14, 2014;

as a negative control (i.e., a *Streptococcus thermophilus* strain having no detectable glucokinase activity): either a *Streptococcus thermophilus* the glcK gene of which is knocked-out or a *Streptococcus thermophilus* the glcK gene of which carries one of the mutations disclosed in WO2013/160413, WO2017/103051 or Sorensen et al. (2016) and summarized in Table 1 below:

TABLE 1

| glcK mutations leading to a strain the glucokinase activity of which is not detectable | | | |
|---|---|---|---|
| Mutation at the glcK gene level | Change at the GlcK protein level | Mutation described in the deposited strain | Strains described in |
| T214C | S72P | DSM25851 | WO2013/160413 |
| C422T | T141I | DSM25850 | WO2013/160413 Sørensen (St1-GS-1) |
| G745A | G249R | DSM28889 | WO2017/103051 Sørensen (St2-GS-1) |

During milk fermentation, the lactose contained in the milk (as the main carbohydrate source in milk) is imported into *Streptococcus thermophilus* strains. The intracellular lactose is then cleaved into glucose and galactose by the beta-galactosidase enzyme (such that 1 mole of lactose gives 1 mole of glucose and 1 mole of galactose).

The feature "glucokinase activity in said strain is significantly reduced but not null" can also be characterized by the maximum forward velocity of the glucokinase (herein called Vmax, and defined as the velocity of the Glucose+ATP conversion to G6P+ADP) or by the inverse of the affinity of the glucokinase (called Km) for one or two of its substrates, i.e., glucose and ATP. In an embodiment, the feature "glucokinase activity in said strain is significantly reduced but not null" for the strain of the invention is further characterized by the maximum forward velocity (Vmax) of its glucokinase in said strain.

Therefore, in combination with the first or second particular embodiment of the feature "glucokinase activity in said strain is significantly reduced but not null" defined herein, the maximum forward velocity (Vmax) of the glucokinase in the lactose-positive, galactose-negative, Streptococcus thermophilus strain of the invention is significantly reduced but not null. The feature "glucokinase Vmax in said strain is significantly reduced but not null" can be defined by one or two of these parameters:
 the Vmax is between 200 and 1500 U/g total protein extract, as assayed by test C.
 the Vmax is between 5 and 60% the Vmax of the glucokinase of the DGCC7710 strain deposited at the DSMZ under accession number DSM28255 on Jan. 14, 2014, when both assayed by test C.

In a particular embodiment, the invention relates to a lactose-positive, galactose-negative, Streptococcus thermophilus strain carrying a mutation in the glcK gene encoding a glucokinase, wherein the glucokinase activity in said strain is significantly reduced but not null (as defined herein), and wherein the maximum forward velocity (Vmax) of its glucokinase in said strain is significantly reduced but not null and defined by one or two of these parameters:
 the Vmax is between 200 and 1500 U/g total protein extract, as assayed by test C.
 the Vmax is between 5 and 60% the Vmax of the glucokinase of the DGCC7710 strain deposited at the DSMZ under accession number DSM28255 on Jan. 14, 2014, when both assayed by test C.

The glucokinase maximum forward velocity (Vmax) in a Streptococcus thermophilus of the invention is assayed by test C [i.e. the test C is carried out using the Streptococcus thermophilus strain of the invention].

Test C:

The maximal forward velocity (Vmax) is determined by using various concentrations of glucose (0, 5, 10, 15, 20 mM) on crude extract prepared as described in test A. Measurements are triplicated for each sample, and the Vmax values given under test C are the mean of three independent experiments. The linear regression representing the inverse of the specific velocity in function of the inverse of the glucose concentration gives the inverse of the maximal forward velocity at the intersection with the Y-axis of the graphic.

In a particular embodiment of the maximum forward velocity of the glucokinase in the Streptococcus thermophilus strain of the invention, the Vmax is between 200 and 1500 U/g total protein extract, as assayed by test C. In a particular embodiment, the Vmax is between 300 and 1200 U/g total protein extract, as assayed by test C. In a particular embodiment, the Vmax is between 400 and 1000 U/g total protein extract. In a particular embodiment, the Vmax of the glucokinase in the Streptococcus thermophilus strain of the invention is between a minimal value selected from the group consisting of 200, 300 and 400 U/g of total protein extract and a maximal value selected from the group consisting of 1000, 1200 and 1500 U/g of total protein extract, as assayed by test C.

In a particular embodiment of the maximum forward velocity of the glucokinase in the Streptococcus thermophilus strain of the invention, the Vmax is between 5 and 60% the Vmax of the glucokinase of the DGCC7710 strain. By "Vmax of the glucokinase of the DGCC7710 strain", it is meant the Vmax of the DGCC7710 strain glucokinase (i.e., with SEQ ID NO:2) as assayed by test C in the DGCC 7710 strain [i.e., the test C is carried out using the DGCC7710 strain]. The percentage value is calculated based on the Vmax of the glucokinase in the strain of the invention and the Vmax of the DGCC7710 strain, both assayed by test C. In a particular embodiment, the glucokinase Vmax in the Streptococcus thermophilus strain of the invention is between 10 and 50% the Vmax of the glucokinase of the DGCC7710 strain, when both assayed by test C. In a particular embodiment, the glucokinase Vmax in the Streptococcus thermophilus strain of the invention is between 15 and 40% the Vmax of the glucokinase of the DGCC7710 strain. In a particular embodiment, the Vmax of the glucokinase in the Streptococcus thermophilus strain of the invention is between a minimal percentage selected from the group consisting of 5, 10 and 15% the Vmax of the glucokinase activity of the DGCC7710 strain and a maximal percentage selected from the group consisting of 40, 50 and 60% the Vmax of the glucokinase activity of the DGCC7710 strain.

The lactose-positive, galactose-negative Streptococcus thermophilus strain of the invention carries a mutation in the glcK gene encoding a glucokinase, the glucokinase activity of which in said strain is significantly reduced but not null as defined herein and optionally wherein the maximum forward velocity of the glucokinase in said strain is significantly reduced but not null as defined herein.

By "mutation in the glck gene" within the present invention, it is meant any nucleotide variation within the glcK gene, wherein said variation at the nucleotide level leads to a glucokinase activity in a strain carrying this mutated glcK gene (as the sole glcK gene) which is significantly reduced but not null as defined herein and optionally leads to a maximum forward velocity of the glucokinase in said strain which is significantly reduced but not null as defined herein. In a particular embodiment, by "mutation in the glck gene" within the present invention, it is meant any nucleotide variation within the open reading frame of the glcK gene, wherein said variation at the nucleotide level leads to a glucokinase activity in a strain carrying this mutated glcK gene (as the sole glcK gene) which is significantly reduced but not null as defined herein and optionally leads to a maximum forward velocity of the glucokinase in said strain which is significantly reduced but not null as defined herein.

Thus, though two Streptococcus thermophilus strains may differ by the sequence of their respective glcK gene, this does not necessarily mean that one of these two glcK genes is mutated in the sense of the invention. Indeed, are not considered as mutations within the present invention:
 variations at the nucleotide level which do not lead to any change at the protein level (silent variation) and which do not impact the translation of the glcK RNA; and
 variations at the nucleotide level which do lead to a change at the protein level, but wherein this change does not impact the glucokinase activity of the resulting GlcK protein and optionally the maximum forward velocity of the resulting GlcK protein, as defined herein. Indeed, such variations can be observed at the level of the glcK gene of the *Streptococcus thermophilus* of the invention without impacting the scope of protection.

Non-limitative examples of glcK genes which are not considered as mutated in the sense of the invention are:

the polynucleotide encoding the glucokinase as defined in SEQ ID NO:2 (GlcK type ST1), in particular the polynucleotide as defined in SEQ ID NO:1; this GlcK type is the one of DGCC7710 strain deposited at the DSMZ under accession number DSM28255 on Jan. 14, 2014;

the polynucleotide encoding the glucokinase as defined in SEQ ID NO:4 (GlcK type ST2), in particular the polynucleotide as defined in SEQ ID NO:3;

the polynucleotide encoding the glucokinase as defined in SEQ ID NO:6 (GlcK type ST3), in particular the polynucleotide as defined in SEQ ID NO:5;

the polynucleotide encoding the glucokinase as defined in SEQ ID NO:8 (GlcK type ST4), in particular the polynucleotide as defined in SEQ ID NO:7;

the polynucleotide encoding the glucokinase as defined in SEQ ID NO:10 (GlcK type ST5), in particular the polynucleotide as defined in SEQ ID NO:9;

the polynucleotide encoding the glucokinase as defined in SEQ ID NO:12 (GlcK type ST6), in particular the polynucleotide as defined in SEQ ID NO:11;

the polynucleotide encoding the glucokinase as defined in SEQ ID NO:14 (GlcK type ST7), in particular the polynucleotide as defined in SEQ ID NO:13;

the polynucleotide encoding the glucokinase as defined in SEQ ID NO:16 (GlcK type ST8), in particular the polynucleotide as defined in SEQ ID NO:15;

the polynucleotide encoding the glucokinase as defined in SEQ ID NO:18 (GlcK type ST9), in particular the polynucleotide as defined in SEQ ID NO:17;

the polynucleotide encoding the glucokinase as defined in SEQ ID NO:20 (GlcK type ST10), in particular the polynucleotide as defined in SEQ ID NO:19.

The amino acid differences at the level of the glucokinase together with the percentage of identity of each GlcK type to SEQ ID NO:2 are summarized in Table 3 (example 2). The glucokinase activity in strains of the GlcK types ST2 to ST10 is summarized in Table 4 (example 3).

Moreover, some nucleotide mutations within the glcK gene are not considered suitable for the purpose of the invention, because they lead to a glucokinase, the activity of which is null or is under the minimal value defined herein, as assayed by test A. Non-limitative examples of non-suitable mutations are described in Table 1. In an embodiment, the *Streptococcus thermophilus* of the invention does not carry a mutation selected from the group consisting of a mutation leading to the knock-out of the glcK gene and large deletions within the glcK gene.

In an embodiment, the lactose-positive, galactose-negative *Streptococcus thermophilus* strain of the invention carries a mutation in the open reading frame of the glcK gene leading to the substitution of an amino acid in the GlcK protein, the glucokinase activity of which in said strain carrying the mutated glcK gene is significantly reduced but not null (as defined herein) and optionally wherein the maximum forward velocity of the glucokinase in said strain is significantly reduced but not null as defined herein. In a particular embodiment, the lactose-positive, galactose-negative *Streptococcus thermophilus* strain of the invention carries a mutation in the glcK gene leading to the substitution of an amino acid in the GlcK protein, the glucokinase activity of which in said strain carrying the mutated glcK gene is significantly reduced but not null (as defined herein) and optionally wherein the maximum forward velocity of the glucokinase in said strain is significantly reduced but not null as defined herein. In a particular embodiment, the *Streptococcus thermophilus* strain of the invention carries a mutation in the glcK gene such that the GlcK protein is 322-amino acids in length and wherein the glucokinase activity in said strain is significantly reduced but not null as defined herein and optionally wherein the maximum forward velocity of the glucokinase in said strain is significantly reduced but not null as defined herein.

As discussed above, some DNA modifications can be observed at the level of the glcK gene of the *Streptococcus thermophilus* of the invention which do not impact the glucokinase activity of the strain. Based on test A defined herein together with the control strains defined herein, the person skilled in the art would know how to identify 1) a glcK gene encoding a glucokinase, the glucokinase activity of which in a strain carrying this glcK gene is significantly reduced but not null (as defined herein) and optionally wherein the maximum forward velocity of the glucokinase in a strain carrying this mutated glcK gene is significantly reduced but not null (as defined herein), 2) a glcK gene bearing a modification having no impact on the glucokinase activity in a strain carrying this modification or 3) a glcK gene encoding a glucokinase, the glucokinase activity of which in a strain carrying this glcK gene is null (as defined herein).

The DGCC7710 strain can be used as a control, by replacing its glcK gene by the glcK gene to be assayed to obtain a derivative of DGCC7710, and assaying the DGCC7710 derivative by test A (glucokinase activity) or test C (Vmax).

The inventors have identified two positions within the glucokinase, for which the amino acid nature has been shown to impact the activity of the glucokinase, such that the glucokinase activity is significantly reduced but not null as defined herein and to impact the Vmax of the glucokinase such that the Vmax is significantly reduced but not null as defined herein: position 144 and position 275 of the glucokinase (i.e., codon 144 and 275 of the glcK gene). It is noteworthy that based on tests A and C defined herein together with the control strains, the person skilled in the art would know how to identify other positions and appropriate amino acids within the glucokinase, to obtain a glucokinase activity significantly reduced but not null (as defined herein) and optionally a maximum forward velocity which is significantly reduced but not null, and thus the corresponding glcK gene.

In an embodiment, the amino acid at position 275 of the glucokinase (encoded by the glcK gene of the *Streptococcus thermophilus* strain of the invention) is not a glutamic acid (i.e., is any amino acid except a glutamic acid); thus, in an embodiment, the codon 275 of the glcK gene carried by the *Streptococcus thermophilus* strain of the invention is neither GAA nor GAG. In a particular embodiment, the amino acid at position 275 of the glucokinase is not an acidic amino acid (i.e., is any amino acid except an acidic amino acid); thus, in an embodiment, the codon 275 of the glcK gene carried by the *Streptococcus thermophilus* strain of the invention is a codon encoding a non-acidic amino acid. In a particular embodiment, the amino acid at position 275 of the glucokinase is selected from the group consisting of lysine and any of its conservative amino acids; thus, in an embodiment, the codon 275 of the glcK gene carried by the *Streptococcus*

*thermophilus* strain of the invention is a codon encoding an amino acid selected from the group consisting of a lysine and any of its conservative amino acids. In a particular embodiment, the amino acid at position 275 of the glucokinase is a lysine; thus, in an embodiment, the codon 275 of the glcK gene carried by the *Streptococcus thermophilus* strain of the invention is either AAA or AAG. In a particular embodiment, the nucleotides 823-825 of the glcK gene carried by the *Streptococcus thermophilus* strain of the invention are AAA or AAG.

In a particular embodiment, the sequence of the GlcK protein of the lactose-positive, galactose-negative *Streptococcus thermophilus* strain of the invention is selected from the group consisting of:

a) a sequence as defined in SEQ ID NO:25, wherein the amino acid at position 275 is any amino acid except a glutamic acid, in particular is any amino acid except an acidic amino acid, in particular is a lysine; and b) a GlcK variant sequence having at least 90% similarity or identity with SEQ ID NO:25, wherein the amino acid of the glucokinase corresponding to position 275 of SEQ ID NO:25 (or the amino acid at position 275 of the glucokinase) is any amino acid except a glutamic acid, in particular is any amino acid except an acidic amino acid, in particular is a lysine. In an embodiment, the GlcK variant sequence is 322-amino acids in length.

In another embodiment, the amino acid at position 144 of the glucokinase (encoded by the glcK gene of the *Streptococcus thermophilus* strain of the invention) is not a glycine is any amino acid except a glycine); thus, in an embodiment, the codon 144 of the glcK gene carried by the *Streptococcus thermophilus* strain of the invention is not GGT, GGC, GGA or GGG. In a particular embodiment, the amino acid at position 144 of the glucokinase is not an aliphatic amino acid (i.e., is any amino acid except an aliphatic amino acid). In a particular embodiment, the amino acid at position 144 of the glucokinase is selected from the group consisting of serine and any of its conservative amino acids; thus, in an embodiment, the codon 144 of the glcK gene carried by the *Streptococcus thermophilus* strain of the invention is a codon encoding an amino acid selected from the group consisting of a serine and any of its conservative amino acids. In a particular embodiment, the amino acid at position 144 of the glucokinase is a serine; thus, in an embodiment, the codon 144 of the glcK gene carried by the *Streptococcus thermophilus* strain of the invention is AGT, AGC, TCT, TCC, TCA or TCG. In a particular embodiment, the nucleotides 430-432 of the glcK gene carried by the *Streptococcus thermophilus* strain of the invention are AGT, AGC, TCT, TCC, TCA or TCG.

In a particular embodiment, the sequence of the GlcK protein of the lactose-positive, galactose-negative *Streptococcus thermophilus* strain of the invention is selected from the group consisting of:

a) a sequence as defined in SEQ ID NO:46, wherein the amino acid at position 144 is any amino acid except a glycine, in particular is any amino acid except an aliphatic amino acid, in particular is a serine; and b) a GlcK variant sequence having at least 90% similarity or identity with SEQ ID NO:46, wherein the amino acid of the glucokinase corresponding to position 144 of SEQ ID NO:46 (or the amino acid at position 144 of the glucokinase) is any amino acid except a glycine, in particular is any amino acid except an aliphatic amino acid, in particular is a serine. In a particular embodiment, the GlcK variant sequence is 322-amino acids in length.

For the definition of the GlcK variant having at least 90% similarity or identity with SEQ ID NO:25, the similarity or identity is calculated herein over the whole length of the 2 sequences after optimal alignment [i.e., number of similar or identical amino acid residues in the aligned parts(s) of the sequences]; the position 275 as defined in SEQ ID NO:25 is not considered for the calculation of the similarity or of the identity. In a particular embodiment, the GlcK variant sequence has at least 91, 92, 93, 94, 95, 96, 97, 98 or 99% similarity or identity with SEQ ID NO:25, wherein the amino acid corresponding to position 275 of SEQ ID NO:25 (or the amino acid at position 275 of the glucokinase) is any amino acid except a glutamic acid, in particular is any amino acid except an acidic amino acid, in particular is a a lysine. In an embodiment, the GlcK variant sequence has at least 95% similarity or identity with SEQ ID NO:25, wherein the amino acid corresponding to position 275 of SEQ ID NO:25 (or the amino acid at position 275 of the glucokinase) is any amino acid except a glutamic acid, in particular is any amino acid except an acidic amino acid, in particular is a lysine. In an embodiment, the GlcK variant sequence has at least 97% similarity or identity with SEQ ID NO:25, wherein the amino acid corresponding to position 275 of SEQ ID NO:25 (or the amino acid at position 275 of the glucokinase) is any amino acid except a glutamic acid, in particular is any amino acid except an acidic amino acid, in particular is a lysine.

In a particular embodiment, the GlcK variant sequence differs from SEQ ID NO:25 by from 1 to 30 amino acid substitutions wherein the amino acid at position 275 of said GlcK variant is any amino acid except a glutamic acid, in particular is any amino acid except an acidic amino acid, in particular is a lysine (the position 275 is not considered for the calculation of the number of substitution(s)). In a particular embodiment, the GlcK variant sequence differs from SEQ ID NO:25 by from 1 to 20 amino acid substitutions, wherein the amino acid at position 275 of said GlcK variant is any amino acid except a glutamic acid, in particular is any amino acid except an acidic amino acid, in particular is a lysine. In a particular embodiment, the GlcK variant sequence differs from SEQ ID NO: 25 by from 1 to 15 amino acid substitutions wherein the amino acid at position 275 of said GlcK variant is any amino acid except a glutamic acid, in particular is any amino acid except an acidic amino acid, in particular is a lysine. In a particular embodiment, the GlcK variant sequence differs from SEQ ID NO: 25 by from 1 to 10 amino acid substitutions wherein the amino acid at position 275 of said GlcK variant is any amino acid except a glutamic acid, in particular is any amino acid except an acidic amino acid, in particular is a lysine. In a particular embodiment, the GlcK variant sequence differs from SEQ ID NO: 25 by 1, 2, 3, 4, 5, 6, 7, 8, 9, 10, 11 or 12 amino acid substitutions, wherein the amino acid at position 275 of said GlcK variant is any amino acid except a glutamic acid, in particular is any amino acid except an acidic amino acid, in particular is a lysine.

For the definition of the GlcK variant having at least 90% similarity or identity with SEQ ID NO:46, the similarity or identity is calculated herein over the whole length of the 2 sequences after optimal alignment [i.e., number of similar or identical amino acid residues in the aligned parts(s) of the sequences]; the position 144 as defined in SEQ ID NO:46 is not considered for the calculation of the similarity or of the identity. In a particular embodiment, the GlcK variant sequence has at least 91, 92, 93, 94, 95, 96, 97, 98 or 99% similarity or identity with SEQ ID NO:46, wherein the amino acid corresponding to position 144 of SEQ ID NO:46 (or the amino acid at position 144 of the glucokinase) is any amino acid except a glycine, in particular is any amino acid except an aliphatic amino acid, in particular is a serine. In an embodiment, the GlcK variant sequence has at least 95% similarity or identity with SEQ ID NO:46, wherein the amino acid corresponding to position 144 of SEQ ID NO:46 (or the amino acid at position 144 of the glucokinase) is any amino acid except a glycine, in particular is any amino acid except an aliphatic amino acid, in particular is a serine. In an embodiment, the GlcK variant sequence has at least 97% similarity or identity with SEQ ID NO:46, wherein the amino acid corresponding to position 144 of SEQ ID NO:46 (or the amino acid at position 144 of the glucokinase) is any amino acid except a glycine, in particular is any amino acid except an aliphatic amino acid, in particular is a serine.

In a particular embodiment, the GlcK variant sequence differs from SEQ ID NO:46 by from 1 to 30 amino acid substitutions wherein the amino acid at position 144 of said GlcK variant is any amino acid except a glycine, in particular is any amino acid except an aliphatic amino acid, in particular is a serine (the position 144 is not considered for the calculation of the number of substitution(s)). In a particular embodiment, the GlcK variant sequence differs from SEQ ID NO:46 by from 1 to 20 amino acid substitutions, wherein the amino acid at position 144 of said GlcK variant is any amino acid except a glycine, in particular is any amino acid except an aliphatic amino acid, in particular is a serine. In a particular embodiment, the GlcK variant sequence differs from SEQ ID NO: 46 by from 1 to 15 amino acid substitutions wherein the amino acid at position 144 of said GlcK variant is any amino acid except a glycine, in particular is any amino acid except an aliphatic amino acid, in particular is a serine. In a particular embodiment, the GlcK variant sequence differs from SEQ ID NO: 46 by from 1 to 10 amino acid substitutions wherein the amino acid at position 144 of said GlcK variant is any amino acid except a glycine, in particular is any amino acid except an aliphatic amino acid, in particular is a serine. In a particular embodiment, the GlcK variant sequence differs from SEQ ID NO:46 by 1, 2, 3, 4, 5, 6, 7, 8, 9, 10, 11 or 12 amino acid substitutions, wherein the amino acid at position 144 of said GlcK variant is any amino acid except a glycine, in particular is any amino acid except an aliphatic amino acid, in particular is a serine.

In an embodiment, the sequence of the GlcK protein of the lactose-positive, galactose-negative *Streptococcus thermophilus* strain of the invention is selected from the group consisting of SEQ ID NOs: 25, 26, 27, 28, 29, 30, 31, 32, 33 and 34, wherein the amino acid at position 275 of said variant is any amino acid except a glutamic acid, in particular is any amino acid except an acidic amino acid, in particular is a lysine; thus, in an embodiment, the glcK gene carried by the *Streptococcus thermophilus* strain of the invention encodes a GlcK protein, the sequence of which is selected from the group consisting of SEQ ID NOs: 25, 26, 27, 28, 29, 30, 31, 32, 33 and 34, wherein the amino acid at position 275 of the glucokinase is not a glutamic acid, in particular is not an acidic amino acid, in particular is a lysine respectively.

In a particular embodiment, either as the SEQ ID NO:25 or any GlcK variant sequence having at least 90% similarity or identity with SEQ ID NO:25 as defined herein (in particular SEQ ID NO: 26, 27, 28, 29, 30, 31, 32, 33 or 34), the amino acid of the glucokinase corresponding to position 275 of SEQ ID NO:25 (or the amino acid at position 275 of the glucokinase) is not a glutamic acid; thus, in an embodiment, the codon 275 of the glcK gene carried by the *Streptococcus thermophilus* strain of the invention is neither GAA nor GAG; thus, in an embodiment, the glcK gene carried by the *Streptococcus thermophilus* strain of the invention encodes a GlcK protein, the sequence of which is selected from the group consisting of SEQ ID NO: 25 and any GlcK variant sequence having at least 90% similarity or identity with SEQ ID NO:25 as defined herein (in particular SEQ ID NO: 26, 27, 28, 29, 30, 31, 32, 33 or 34), wherein the amino acid of the glucokinase corresponding to position 275 of SEQ ID NO:25 (or the amino acid at position 275 of the glucokinase) is not a glutamic acid.

In a particular embodiment, either as the SEQ ID NO:25 or any GlcK variant sequence having at least 90% similarity or identity with SEQ ID NO:25 as defined herein (in particular SEQ ID NO: 26, 27, 28, 29, 30, 31, 32, 33 or 34), the amino acid of the glucokinase corresponding to position 275 of SEQ ID NO:25 (or the amino acid at position 275 of the glucokinase) is not an acidic amino acid; thus, in an embodiment, the codon 275 of the glcK gene carried by the *Streptococcus thermophilus* strain of the invention is a codon which does not encode an acidic amino acid; thus, in an embodiment, the glcK gene carried by the *Streptococcus thermophilus* strain of the invention encodes a GlcK protein, the sequence of which is selected from the group consisting of SEQ ID NO: 25 and any GlcK variant sequence having at least 90% similarity or identity with SEQ ID NO:25 as defined herein (in particular SEQ ID NO: 26, 27, 28, 29, 30, 31, 32, 33 or 34), wherein the amino acid of the glucokinase corresponding to position 275 of SEQ ID NO:25 (or the amino acid at position 275 of the glucokinase) is not an acidic amino acid.

In a particular embodiment, either as the SEQ ID NO:25 or any GlcK variant sequence having at least 90% similarity or identity with SEQ ID NO:25 as defined herein (in particular SEQ ID NO: 26, 27, 28, 29, 30, 31, 32, 33 or 34), the amino acid of the glucokinase corresponding to position 275 of SEQ ID NO:25 (or the amino acid at position 275 of the glucokinase) is selected from the group consisting of lysine and any of its conservative amino acids; thus, in an embodiment, the codon 275 of the glcK gene carried by the *Streptococcus thermophilus* strain of the invention is a codon encoding an amino acid selected from the group consisting of lysine and any of its conservative amino acids; thus, in an embodiment, the glcK gene carried by the *Streptococcus thermophilus* strain of the invention encodes a GlcK protein, the sequence of which is selected from the group consisting of SEQ ID NO: 25 and any GlcK variant sequence having at least 90% similarity or identity with SEQ ID NO:25 as defined herein (in particular SEQ ID NO: 26, 27, 28, 29, 30, 31, 32, 33 or 34), wherein the amino acid of the glucokinase corresponding to position 275 of SEQ ID NO:25 (or the amino acid at position 275 of the glucokinase) is a lysine and any of its conservative amino acids.

In a particular embodiment, either as the SEQ ID NO:25 or any GlcK variant sequence having at least 90% similarity or identity with SEQ ID NO:25 as defined herein (in particular SEQ ID NO: 26, 27, 28, 29, 30, 31, 32, 33 or 34), the amino acid of the glucokinase corresponding to position 275 of SEQ ID NO:25 (or the amino acid at position 275 of the glucokinase) is a lysine; thus, in an embodiment, the codon 275 of the glcK gene carried by the *Streptococcus thermophilus* strain of the invention is a codon encoding a lysine respectively, in particular is AAA or AAG, respectively; thus, in a particular embodiment, the sequence of the GlcK protein of the lactose-positive, galactose-negative *Streptococcus thermophilus* strain of the invention is selected from the group consisting of SEQ ID NOs: 22, 35, 36, 37, 38, 39, 40, 41, 42 and 43; thus, in an embodiment, the glcK gene carried by the *Streptococcus thermophilus* strain of the invention encodes a GlcK protein, the sequence of which is selected from the group consisting of SEQ ID NOs: 22, 35, 36, 37, 38, 39, 40, 41, 42 and 43; in a particular embodiment, the glcK gene carried by the *Streptococcus thermophilus* strain of the invention is as defined in SEQ ID NO:21.

In another embodiment, the sequence of the GlcK protein of the lactose-positive, galactose-negative *Streptococcus thermophilus* strain of the invention is selected from the group consisting of SEQ ID NOs: 46, 47, 48, 49, 50, 51, 52, 53, 54 and 55, wherein the amino acid at position 144 of said variant is any amino acid except a glycine, in particular is any amino acid except an aliphatic amino acid, in particular is a serine; thus, in an embodiment, the glcK gene carried by the *Streptococcus thermophilus* strain of the invention encodes a GlcK protein, the sequence of which is selected from the group consisting of SEQ ID NOs: 46, 47, 48, 49, 50, 51, 52, 53, 54 and 55, wherein the amino acid at position 144 of the glucokinase is not a glycine, in particular is not an aliphatic amino acid, in particular is a serine.

In a particular embodiment, either as the SEQ ID NO:46 or any GlcK variant sequence having at least 90% similarity or identity with SEQ ID NO:46 as defined herein (in particular SEQ ID NO: 47, 48, 49, 50, 51, 52, 53, 54 or 55), the amino acid of the glucokinase corresponding to position 144 of SEQ ID NO:46 (or the amino acid at position 144 of the glucokinase) is not a glycine; thus, in an embodiment, the codon 144 of the glcK gene carried by the *Streptococcus thermophilus* strain of the invention is not GGT, GGC, GGA or GGG; thus, in an embodiment, the glcK gene carried by the *Streptococcus thermophilus* strain of the invention encodes a GlcK protein, the sequence of which is selected from the group consisting of SEQ ID NO: 46 and any GlcK variant sequence having at least 90% similarity or identity with SEQ ID NO:46 as defined herein (in particular SEQ ID NO: 47, 48, 49, 50, 51, 52, 53, 54 or 55), wherein the amino acid of the glucokinase corresponding to position 144 of SEQ ID NO:46 (or the amino acid at position 144 of the glucokinase) is not a glycine.

In a particular embodiment, either as the SEQ ID NO:46 or any GlcK variant sequence having at least 90% similarity or identity with SEQ ID NO:46 as defined herein (in particular SEQ ID NO: 47, 48, 49, 50, 51, 52, 53, 54 or 55), the amino acid of the glucokinase corresponding to position 144 of SEQ ID NO:46 (or the amino acid at position 144 of the glucokinase) is not an aliphatic amino acid; thus, in an embodiment, the codon 144 of the glcK gene carried by the *Streptococcus thermophilus* strain of the invention is a codon which does not encode an aliphatic amino acid; thus, in an embodiment, the glcK gene carried by the *Streptococcus thermophilus* strain of the invention encodes a GlcK protein, the sequence of which is selected from the group consisting of SEQ ID NO:46 and any GlcK variant sequence having at least 90% similarity or identity with SEQ ID NO:46 as defined herein (in particular SEQ ID NO: 47, 48, 49, 50, 51, 52, 53, 54 or 55), wherein the amino acid of the glucokinase corresponding to position 144 of SEQ ID NO:46 (or the amino acid at position 144 of the glucokinase) is not an aliphatic amino acid.

In a particular embodiment, either as the SEQ ID NO:46 or any GlcK variant sequence having at least 90% similarity or identity with SEQ ID NO:46 as defined herein (in particular SEQ ID NO: 47, 48, 49, 50, 51, 52, 53, 54 or 55), the amino acid of the glucokinase corresponding to position 144 of SEQ ID NO:46 (or the amino acid at position 144 of the glucokinase) is selected from the group consisting of serine and any of its conservative amino acids; thus, in an embodiment, the codon 144 of the glcK gene carried by the *Streptococcus thermophilus* strain of the invention is a codon encoding an amino acid selected from the group consisting of serine and any of its conservative amino acids; thus, in an embodiment, the glcK gene carried by the *Streptococcus thermophilus* strain of the invention encodes a GlcK protein, the sequence of which is selected from the group consisting of SEQ ID NO: 46 and any GlcK variant sequence having at least 90% similarity or identity with SEQ ID NO:46 as defined herein (in particular SEQ ID NO: 47, 48, 49, 50, 51, 52, 53, 54 or 55), wherein the amino acid of the glucokinase corresponding to position 144 of SEQ ID NO:46 (or the amino acid at position 144 of the glucokinase) is a serine and any of its conservative amino acids.

In a particular embodiment, either as the SEQ ID NO:46 or any GlcK variant sequence having at least 90% similarity or identity with SEQ ID NO:46 as defined herein (in particular SEQ ID NO: 47, 48, 49, 50, 51, 52, 53, 54 or 55), the amino acid of the glucokinase corresponding to position 144 of SEQ ID NO:46 (or the amino acid at position 144 of the glucokinase) is a serine; thus, in an embodiment, the codon 144 of the glcK gene carried by the *Streptococcus thermophilus* strain of the invention is a codon encoding a serine, in particular is AAA or AAG; thus, in a particular embodiment, the sequence of the GlcK protein of the lactose-positive, galactose-negative *Streptococcus thermophilus* strain of the invention is selected from the group consisting of SEQ ID NOs: 45, 56, 57, 58, 59, 60, 61, 62, 63 and 64; thus, in an embodiment, the glcK gene carried by the *Streptococcus thermophilus* strain of the invention encodes a GlcK protein, the sequence of which is selected from the group consisting of SEQ ID NOs: 45, 56, 57, 58, 59, 60, 61, 62, 63 and 64; in a particular embodiment, the glcK gene carried by the *Streptococcus thermophilus* strain of the invention is as defined in SEQ ID NO:44.

When defining the sequence of the GlcK protein of the lactose-positive, galactose-negative *Streptococcus thermophilus* strain of the invention, it is according to the teaching of this application that the glucokinase activity in the strain expressing this GlcK protein is significantly reduced but not null as defined herein and optionally that the Vmax of the glucokinase in this strain is significantly reduced but not null as defined herein.

In addition to be characterized by a significantly reduced but not null glucokinase activity as defined herein and optionally by a significantly reduced but not null maximum forward velocity (Vmax) of its glucokinase as defined herein, the lactose-positive, galactose-negative, *Streptococcus thermophilus* strain can be further characterized by its behaviour (ability to release glucose) when used to ferment milk. In addition to be characterized by a ratio of the beta-galactosidase activity in said strain as assayed by test D over the glucokinase activity in said strain as assayed by test E which is at least $4 \cdot 10^{-6}$ as defined herein, the lactose-positive, galactose-negative, *Streptococcus thermophilus* strain can be further characterized by its behaviour (ability to release glucose) when used to ferment milk. In addition to be characterized by a ratio of the beta-galactosidase activity in said strain as assayed by test D over the glucokinase activity in said strain as assayed by test E which is at least $4 \cdot 10^{-6}$ as defined herein, and by a significantly reduced but not null glucokinase activity as defined herein and optionally by a significantly reduced but not null maximum forward velocity (Vmax) of its glucokinase as defined herein, the lactose-positive, galactose-negative, *Streptococ-*

*cus thermophilus* strain can be further characterized by its behaviour (ability to release glucose) when used to ferment milk.

Thus, the lactose-positive, galactose-negative, *Streptococcus thermophilus* strain, carrying a mutation in the glcK gene, of the invention is further characterized by at least one of these features, when used to ferment milk, in particular by one of these features or by the combination of these 2 features:

1) when said strain is used to ferment milk as assayed by test B, the ratio of the amount of glucose accumulated/released (mM) in said fermented milk over the amount of consumed lactose by said strain (mM) is more than 20%;

2) when said strain is used to ferment milk as assayed by test B, the concentration of glucose in said fermented milk is at least 10 mM;

Each of these features will be described separately hereafter though as mentioned above, the lactose-positive, galactose-negative, *Streptococcus thermophilus* strain of the invention—having a significantly reduced but not null glucokinase activity as defined herein and optionally having a significantly reduced maximum forward velocity (Vmax) of its glucokinase as defined herein—can be further characterized by 1 of these features or the combination of these 2 features.

1) In a particular embodiment, (alone or in combination with feature 2), the *Streptococcus thermophilus* strain of the invention, carry a mutation in the glcK gene, is further characterized by the fact that when said strain is used to ferment milk as assayed by test B, the ratio of the amount of glucose accumulated/released (mM) in said fermented milk over the amount of consumed lactose by said strain (mM) is more than 20%

Indeed, as a result of the "significantly reduced but not null" glucokinase activity in a strain of the invention and optionally as the result of the "significantly reduced but not null" Vmax of the glucokinase in said strain, less than 80% of the moles of glucose coming from the consumed lactose (disaccharide made of glucose and galactose) are used by this strain, such that at least 20% of the moles of glucose coming from the consumed lactose are released into the milk during fermentation. After fermentation of the milk using test B described herein, the number of moles of consumed lactose is determined by calculating the number of moles of lactose in the milk before fermentation minus the number of moles of lactose remaining in the fermented milk after fermentation. After fermentation of the milk using test B described herein, the number of moles of glucose found in the fermented milk after fermentation minus the number of moles of glucose that may already be present in the milk before fermentation (if any) is determined (accumulated glucose). Then, the ratio of accumulated glucose over consumed lactose is calculated, and represent the % of glucose moiety of the consumed lactose which is released and accumulated in said fermented milk. In a particular embodiment, when a strain of the invention is used to ferment milk as assayed by test B, the ratio of the amount of glucose accumulated/released (mM) in said fermented milk over the amount of consumed lactose by said strain (mM) is more than 30%. In a particular embodiment, when a strain of the invention is used to ferment milk as assayed by test B, the ratio of the amount of glucose accumulated/released (mM) in said fermented milk over the amount of consumed lactose by said strain (mM) is more than 40%. In a particular embodiment, when a strain of the invention is used to ferment milk as assayed by test B, the ratio of the amount of glucose accumulated/released (mM) in said fermented milk over the amount of consumed lactose by said strain (mM) is more than 50%. In a particular embodiment, when a strain of the invention is used to ferment milk as assayed by test B, the ratio of the amount of glucose accumulated/released (mM) in said fermented milk over the amount of consumed lactose by said strain (mM) is more than 60%. In a particular embodiment, when a strain of the invention is used to ferment milk as assayed by test B, the ratio of the amount of glucose accumulated/released (mM) in said fermented milk over the amount of consumed lactose by said strain (mM) is selected from the group consisting of a ratio which is more than 30%, more than 40%, more than 50 and more than 60%.

2) In a particular embodiment (alone or in combination with feature 1), the *Streptococcus thermophilus* strain of the invention, carrying a mutation in the glcK gene, is further characterized by the fact that the concentration of glucose in a milk fermented with said *Streptococcus thermophilus* strain as assayed by test B, is at least 10 mM. In a particular embodiment, the concentration of glucose in a milk fermented with said *Streptococcus thermophilus* strain as assayed by test B, is at least 15 mM. In a particular embodiment, the concentration of glucose in a milk fermented with said *Streptococcus thermophilus* strain as assayed by test B, is at least 20 mM. In a particular embodiment, the concentration of glucose in a milk fermented with said *Streptococcus thermophilus* strain as assayed by test B, is at least 25 mM. In a particular embodiment, the concentration of glucose in a milk fermented with said *Streptococcus thermophilus* strain as assayed by test B is selected from the group consisting of a concentration with is at least 10 mM, at least 15 mM, at least 20 mM and at least 25 mM.

Thus, in a particular embodiment, the lactose-positive, galactose-negative, *Streptococcus thermophilus* strain of the invention having significantly reduced but not null glucokinase activity as defined herein and optionally having a significantly reduced but not null maximum forward velocity (Vmax) of its glucokinase as defined herein, is further characterized by 1 of these features or the combination of these 2 features:

1) when said strain is used to ferment milk as assayed by test B, the ratio of the amount of glucose accumulated/released (mM) in said fermented milk over the amount of consumed lactose by said strain (mM) is selected from the group consisting of a ratio which is more than 30%, 40%, 50 and 60%;

2) when said strain is used to ferment milk as assayed by test B, the concentration of glucose in said fermented milk is selected from the group consisting of a concentration with is at least 10 mM, at least 15 mM, at least 20 mM and at least 25 mM;

II. A Lactose-Positive, Galactose-Negative, *Streptococcus thermophilus* Strain of the Invention Carrying a Mutation in its ccpA Gene.

The invention is directed to a lactose-positive, galactose-negative, *Streptococcus thermophilus* strain carrying a mutation in the ccpA gene, wherein the ratio of the beta-galactosidase activity in said strain as assayed by test D over the glucokinase activity in said strain as assayed by test E is at least $4 \cdot 10^{-6}$ as defined herein.

Any mutation can be introduced into the ccpA gene of the *Streptococcus thermophilus* strain, as long as the above-mentioned ratio of the lactose-positive, galactose-negative, *Streptococcus thermophilus* strain bearing this mutated ccpA gene is obtained.

In an embodiment, the ccpA gene mutation is not a mutation leading to the knock-out (i.e., the complete disruption) of the gene.

In an embodiment, the ccpA gene mutation is a mutation in the coding sequence of the ccpA gene, in particular in the first 270 nucleotides of the coding sequence of the ccpA gene. In an embodiment, the mutation is a mutation selected from the group consisting of:
  a) a non-sense mutation (i.e. leading to a STOP codon) located between the nucleotide 1 and the nucleotide 270 of the coding sequence of the ccpA gene; and
  b) a mutation, located in the first quarter of the coding sequence of the ccpA gene (i.e., between nucleotide 1 and the nucleotide 250), leading to a frameshift of the open reading frame of the ccpA gene.

In an embodiment, the mutation leading to a frameshift of the open reading frame of the ccpA gene is located between nucleotide 50 and the nucleotide 200 of the coding sequence of the ccpA gene. In an embodiment, the mutation leading to a frameshift of the open reading frame of the ccpA gene is located between nucleotide 100 and the nucleotide 150 of the coding sequence of the ccpA gene. Whatever the location of the mutation leading to a frameshift, the mutation is selected from the group consisting of a deletion, an insertion or a deletion/insertion (which all are not a multiple of 3).

Though two *Streptococcus thermophilus* strains may differ by the sequence of their respective ccpA gene, this does not necessarily mean that one of these two ccpA genes is mutated in the sense of the invention. Indeed, are not considered as mutations of the ccpA gene within the present invention:
  variations at the nucleotide level which do lead to a change at the protein level, but wherein this change does not enable to obtain a ratio—of the beta-galactosidase activity as assayed by test D over the glucokinase activity as assayed by test E in the lactose-positive, galactose-negative, *Streptococcus thermophilus* strain encoding this modified protein of at least $4 \cdot 10^{-6}$ Non-limitative examples of ccpA genes which are not considered as mutated in the sense of the invention are:
  the polynucleotide as defined in SEQ ID NO:65 (ccpA type ST1); this ccpA type is the one of the DGCC7710 strain;
  the polynucleotide as defined in SEQ ID NO:66 (ccpA type ST2), which has 99.8% identity with SEQ ID NO:65;
  the polynucleotide as defined in SEQ ID NO:67 (ccpA type ST3), which has 99.8% identity with SEQ ID NO:65;
  the polynucleotide as defined in SEQ ID NO:68 (ccpA type ST4), which has 99.7% identity with SEQ ID NO:65;
  the polynucleotide as defined in SEQ ID NO:69 (ccpA type ST5), which has 99.8% identity with SEQ ID NO:65; and
  the polynucleotide as defined in SEQ ID NO:70 (ccpA type ST6), which has 99.7% identity with SEQ ID NO:65.

The inventors have identified at least one mutation, which when present into the ccpA gene of a lactose-positive, galactose-negative, *Streptococcus thermophilus* strain enables this strain to exhibit a ratio of the beta-galactosidase activity in said strain as assayed by test D over the glucokinase activity in said strain as assayed by test E of at least $4 \cdot 10^{-6}$ as defined herein. Thus, the invention is directed to a lactose-positive, galactose-negative, *Streptococcus thermophilus* strain carrying a mutation in the ccpA gene selected from the group consisting of a non-sense mutation located between the nucleotide 1 and the nucleotide 270 of the coding sequence of the ccpA gene and a mutation, located in the first quarter of the coding sequence of the ccpA gene, leading to a frameshift of the open reading frame of the ccpA gene, wherein the ratio of the beta-galactosidase activity in said strain as assayed by test D over the glucokinase activity in said strain as assayed by test E is at least $4 \cdot 10^{-6}$ as defined herein.

In an embodiment, the mutation of the ccpA gene is a deletion of a nucleotide A in the stretch of 7 nucleotides A at positions 114-120 (leading to a frameshift of the open reading frame of the ccpA gene). Such *Streptococcus thermophilus* mutated ccpA gene is referred herein as ccpA$_{A14114-120}$. In an embodiment, the sequence of said mutated ccpA gene is selected from the group consisting of:
  a) a sequence as defined in SEQ ID NO:71; and
  b) a ccpA variant sequence having at least 90% identity with SEQ ID NO:71. The ccpA variant as defined herein carries a mutation as defined above, i.e., is selected from the group consisting of a non-sense mutation located between the nucleotide 1 and the nucleotide 270 of the coding sequence of the ccpA gene and a mutation, located in the first quarter of the coding sequence of the ccpA, leading to a frameshift of the open reading frame of the ccpA gene.

For the definition of the ccpA variant having at least 90% identity with SEQ ID NO:71, the identity is calculated herein over the whole length of the 2 sequences after optimal alignment [i.e., number of identical nucleotides in the aligned parts(s) of the sequences]. In a particular embodiment, the ccpA variant sequence has at least 91, 92, 93, 94, 95, 96, 97, 98 or 99% identity with SEQ ID NO:71. In an embodiment, the ccpA variant sequence differs from SEQ ID NO: 71 by from 1 to 30 nucleotide substitutions. In a particular embodiment, the ccpA variant sequence differs from SEQ ID NO: 71 by from 1 to 20 nucleotide substitutions. In a particular embodiment, the ccpA variant sequence differs from SEQ ID NO: 71 by from 1 to 15 nucleotide substitutions. In a particular embodiment, the ccpA variant sequence differs from SEQ ID NO: 71 by from 1 to 10 nucleotide substitutions. In a particular embodiment, the ccpA variant sequence differs from SEQ ID NO: 71 by 1, 2, 3, 4, 5, 6, 7, 8, 9 or 10 nucleotide substitutions. In an embodiment, the sequence of the ccpA gene of the lactose-positive, galactose-negative *Streptococcus thermophilus* strain of the invention is selected from the group consisting of SEQ ID NOs: 71, 72, 73, 74, 75 and 76.

In addition to be characterized by a ratio of beta-galactosidase activity in said strain as assayed by test D over the glucokinase activity in said strain as assayed by test E of at least $4 \cdot 10^{-6}$ as defined herein, the lactose-positive, galactose-negative, *Streptococcus thermophilus* strain of the invention, carrying a mutated ccpA gene, can be further characterized by its ability to release glucose when used to ferment milk.

Thus, the lactose-positive, galactose-negative, *Streptococcus thermophilus* strain, carrying a mutation in the ccpA gene, of the invention is further characterized by the fact that the concentration of glucose in a milk fermented with said *Streptococcus thermophilus* strain as assayed by test B, is at least 8 mM. In a particular embodiment, the concentration of glucose in a milk fermented with said *Streptococcus thermophilus* strain as assayed by test B, is at least 9 mM. In a particular embodiment, the concentration of glucose in a milk fermented with said *Streptococcus thermophilus* strain as assayed by test B, is at least 10 mM. In a particular embodiment, the concentration of glucose in a milk fermented with said *Streptococcus thermophilus* strain as assayed by test B, is at least 12 mM. In a particular embodiment, the concentration of glucose in a milk fermented with said *Streptococcus thermophilus* strain as assayed by test B is selected from the group consisting of a concentration with is at least 8 mM, at least 9 mM, at least 10 mM and at least 12 mM.

The person skilled in the art is given, in this part of the application, guidance on how to obtain and identify mutations of the ccpA gene other than the one specifically disclosed. Based on the ratio defined above [beta-galactosidase activity in said strain as assayed by test D over the glucokinase activity in said strain as assayed by test E] together with a reference strain defined herein, the person skilled in the art would know how to identify a mutated ccpA gene according to the invention and to obtain a *Streptococcus thermophilus* strain of the invention.

Thus, the person skilled in the art can proceed by the following method:
a) provide a *Streptococcus thermophilus* strain, the ccpA gene of which is as defined in SEQ ID NO:65, such as the DGCC7710 strain;
b) carry out mutagenesis on the ccpA gene, for example by random or directed mutagenesis, to obtain a ccpA gene the sequence of which is different from the sequence of the ccpA gene of the strain in a);
c) insert the ccpA gene obtained in b) in lieu of the ccpA gene of the DGCC7710 strain, to obtain a DGCC7710 derivative;
d) determining the ratio beta-galactosidase activity as assayed by test D over the glucokinase activity as assayed by test E of said DGCC7710 derivative, wherein a ratio of at least $4 \cdot 10^{-6}$ means that the inserted ccpA gene is a mutated ccpA gene according to the invention. In a particular embodiment, a mutated ccpA gene is considered to be according to the invention when the ratio beta-galactosidase activity as assayed by test D over the glucokinase activity as assayed by test E of said DGCC7710 derivative is at least $5 \cdot 10^{-6}$, at least $6 \cdot 10^{-6}$, at least $7 \cdot 10^{-6}$ or at least $8 \cdot 10^{-6}$. In an embodiment, said ratio is less than $8 \cdot 10^{-3}$.

In addition, the person skilled in the art, to obtain and identify a mutated ccpA gene according to the invention and to obtain a *Streptococcus thermophilus* of the invention, can also proceed by the following method:
a) provide a *Streptococcus thermophilus* strain, the ccpA gene of which is as defined in SEQ ID NO:65, such as the DGCC7710 strain;
b) carry out mutagenesis on the ccpA gene, for example by random or directed mutagenesis, to obtain a ccpA gene the sequence of which is different from the sequence of the ccpA gene of the strain in a);
c) insert the ccpA gene obtained in b) in lieu of the ccpA gene of the DGCC7710 strain, to obtain a DGCC7710 derivative;
d) determining the ratio beta-galactosidase activity as assayed by test D over the glucokinase activity as assayed by test E of said DGCC7710 derivative, and selecting a DGCC7710 derivative presenting a ratio of at least $4 \cdot 10^{-6}$ as defined herein; and
e) determining by test B the concentration of glucose in a milk fermented with said DGCC7710 derivative selected in d), wherein a glucose concentration of at least 8 mM means that the inserted ccpA gene is a mutated ccpA gene according to the invention. In a particular embodiment, a mutated ccpA gene is considered to be according to the invention when the glucose concentration measured in step e) is at least 9 mM, at least 10 mM or at least 12 mM.

Alternatively, the person skilled in the art can proceed by the following method:
a) provide the DSM32587 strain (mutated in its glcK gene), deposited at the DSMZ on Aug. 15, 2017;
b) carry out mutagenesis on the ccpA gene of the strain in a), for example by random or directed mutagenesis, to obtain a ccpA gene, the sequence of which is different from the sequence of the ccpA gene of DSM32587, to obtain a ccpA-mutated DSM32587 strain;
c) determining the ratio beta-galactosidase activity as assayed by test D over the glucokinase activity as assayed by test E of the ccpA-mutated DSM32587 strain obtained in b), and selecting a ccpA-mutated DSM32587 strain presenting a ratio of at least $4 \cdot 10^{-6}$; and
d) determining by test B the concentration of glucose in a milk fermented with said ccpA-mutated DSM32587 strain selected in c), wherein
d1) a glucose concentration of at least 50 mM means that the mutated ccpA gene is according to the invention. In an embodiment, a mutated ccpA gene is considered to be according to the invention when the glucose concentration measured in step d) is at least 60 mM, at least 70 mM or at least 80 mM, or
d2) an increase of the glucose concentration obtained with said ccpA-mutated DSM32587 strain selected in c) of at least 150% as compared to the glucose concentration obtained with DSM32587 strain, when both assayed by test B, means that the mutated ccpA gene is according to the invention. In an embodiment, a mutated ccpA gene is considered to be according to the invention when the glucose increase in step d) is at least 200% or at least 300% the glucose concentration of the DSM32587 strain.

Once identified, a mutated ccpA gene as identified herein—can be introduced in lieu of the ccpA gene of a lactose-positive, galactose-negative, *Streptococcus thermophilus* strain, to obtain a lactose-positive, galactose-negative, *Streptococcus thermophilus* strain of the invention.

III. A Lactose-Positive, Galactose-Negative, *Streptococcus thermophilus* Strain of the Invention Carrying a Mutation in its glcK Gene and a Mutation in its ccpA Gene.

The invention is directed to a lactose-positive, galactose-negative, *Streptococcus thermophilus* strain carrying a mutation in the glcK gene encoding a glucokinase, the glucokinase activity of which in said strain is significantly reduced but not null, as defined herein, and carrying a mutation in its ccpA gene, wherein the ratio of the beta-galactosidase activity in said strain as assayed by test D over the glucokinase activity in said strain as assayed by test E is at least $4 \cdot 10^{-6}$ as defined herein.

In an embodiment, any mutation of the glcK gene leading to a glucokinase, the activity of which in said strain is significantly reduced but not null, as described herein (in particular under I above) can be used in combination with any ccpA mutation, as long as the ratio of the beta-galactosidase activity in said strain as assayed by test D over the glucokinase activity in said strain as assayed by test E is at least $4 \cdot 10^{-6}$ as defined herein. In other words, the invention is directed to a lactose-positive, galactose-negative, *Streptococcus thermophilus* strain carrying a mutation in the glcK gene as defined herein (in particular under I above), and further carrying a mutation in the ccpA gene.

In an embodiment, any ccpA mutation leading to a ratio of the beta-galactosidase activity as assayed by test D over the glucokinase activity as assayed by test E—in a lactose-positive, galactose-negative, *Streptococcus thermophilus* strain bearing this mutated ccpA gene, in particular in the DGCC7710 strain—of at least $4·10^{-6}$ as described herein (in particular under II above) can be used with any glcK mutation, as long as the ratio of the beta-galactosidase activity in said strain as assayed by test D over the glucokinase activity in said strain as assayed by test E is at least $4·10^{-6}$ as defined herein. In other words, the invention is directed to a lactose-positive, galactose-negative, *Streptococcus thermophilus* strain carrying a mutation in the ccpA gene, wherein the ratio of the beta-galactosidase activity in said strain as assayed by test D over the glucokinase activity in said strain as assayed by test E is at least $4·10^{-6}$ as defined herein (in particular under II above), and further carrying a mutation in the glcK gene.

In an embodiment, the invention is directed to a lactose-positive, galactose-negative, *Streptococcus thermophilus* strain carrying:
  a mutated glcK gene leading to a glucokinase, the activity of which in said strain is significantly reduced but not null, as defined in a lactose-positive, galactose-negative, *Streptococcus thermophilus* strain as defined herein, in particular under I above; and
  a mutated ccpA gene leading to a ratio of the beta-galactosidase activity as assayed by test D over the glucokinase activity as assayed by test E of at least $4·10^{-6}$, as defined herein, in particular as defined in a lactose-positive, galactose-negative, *Streptococcus thermophilus* strain under II above.

Thus, any of the embodiments disclosed above for the mutated glcK gene leading to a glucokinase, the activity of which in said strain is significantly reduced but not null, can be combined with any of the embodiments disclosed herein for the mutated ccpA gene leading to a ratio of the beta-galactosidase activity as assayed by test D over the glucokinase activity as assayed by test E of at least $4·10^{-6}$, as long as the obtained lactose-positive, galactose-negative, *Streptococcus thermophilus* strain carrying both mutations exhibits a ratio of the beta-galactosidase activity in said strain as assayed by test D over the glucokinase activity in said strain as assayed by test E of at least $4·10^{-6}$ as defined herein.

In an embodiment, the lactose-positive, galactose-negative, *Streptococcus thermophilus* strain of the invention carries:
  a glcK gene coding for a glucokinase mutated in its open reading frame, in particular leading to an amino acid substitution in the GlcK protein, wherein the activity of the glucokinase in said strain is significantly reduced but not null; and
  a ccpA gene carrying a mutation selected from the group consisting of a) a non-sense mutation (i.e. leading to a STOP codon) located between the nucleotide 1 and the nucleotide 270 of the coding sequence of the ccpA gene; and b) a mutation, located in the first quarter of the coding sequence of the ccpA gene (i.e., between nucleotide 1 and the nucleotide 250), leading to a frameshift of the open reading frame of the ccpA gene.

In an embodiment, the lactose-positive, galactose-negative, *Streptococcus thermophilus* strain of the invention carries:
  a mutated glcK gene coding for a glucokinase, the position 144 of which is not a glycine, in particular is a serine or the position 275 of which is not a glutamic acid, in particular is a lysine; and
  a ccpA gene carrying a mutation leading to a frameshift of the open reading frame of the ccpA gene located between nucleotide 50 and the nucleotide 200 of the coding sequence of the ccpA gene.

In an embodiment, the lactose-positive, galactose-negative, *Streptococcus thermophilus* strain of the invention carries:
  a mutated glcK gene coding for a glucokinase, the position 144 of which is a serine or the position 275 of which is a lysine; and
  a ccpA gene carrying a mutation leading to a frameshift of the open reading frame of the ccpA gene located between nucleotide 100 and the nucleotide 150 of the coding sequence of the ccpA gene.

In an embodiment, the lactose-positive, galactose-negative, *Streptococcus thermophilus* strain of the invention carries:
  a mutated glcK gene encoding a glucokinase, the sequence of which is selected from the group consisting of SEQ ID NO: 22, 35, 36, 37, 38, 39, 40, 41, 42, 43, 45, 56, 57, 58, 59, 60, 61, 62, 63 and 64 (in particular SEQ ID NO:22 and 45); and
  a mutated ccpA gene, the sequence of which is selected from the group consisting of SEQ ID NO: 71, 72, 73, 74, 75 and 76 (in particular is SEQ ID NO: 71).

In addition to be characterized by a ratio beta-galactosidase activity in said strain as assayed by test D over the glucokinase activity in said strain as assayed by test E of at least $4·10^{-6}$ as defined herein, the lactose-positive, galactose-negative, *Streptococcus thermophilus* strain of the invention, carrying a mutated glcK gene and a mutated ccpA gene, can be further characterized by its ability to release glucose when used to ferment milk.

Thus, the lactose-positive, galactose-negative, *Streptococcus thermophilus* strain, carrying a mutation in the glcK gene and a mutation in the ccpA gene, of the invention is further characterized by the fact that the concentration of glucose in a milk fermented with said *Streptococcus thermophilus* strain as assayed by test B, is at least 50 mM. In a particular embodiment, the concentration of glucose in a milk fermented with said *Streptococcus thermophilus* strain as assayed by test B, is at least 60 mM. In a particular embodiment, the concentration of glucose in a milk fermented with said *Streptococcus thermophilus* strain as assayed by test B, is at least 70 mM. In a particular embodiment, the concentration of glucose in a milk fermented with said *Streptococcus thermophilus* strain as assayed by test B, is at least 80 mM. In a particular embodiment, the concentration of glucose in a milk fermented with said *Streptococcus thermophilus* strain as assayed by test B is selected from the group consisting of a concentration with is at least 50 mM, at least 60 mM, at least 70 mM and at least 80 mM.

The methods detailed above, on the one hand, to obtain and identify a mutated glcK gene in a lactose-positive, galactose-negative, *Streptococcus thermophilus* strain of the invention, and on the other hand to identify a ccpA mutated gene in a lactose-positive, galactose-negative, *Streptococcus thermophilus* strain of the invention, apply similarly herein, to obtain a lactose-positive, galactose-negative, *Streptococcus thermophilus* strain carrying a mutation in its glcK gene and in its ccpA gene.

As an example, the person skilled in the art can proceed by the following method to obtain and identify a mutated ccpA gene according to the invention:
  a) provide the DSM32587 strain (mutated in its glcK gene);

b) carry out mutagenesis on the ccpA gene of the strain in a), for example by random or directed mutagenesis, to obtain a ccpA gene, the sequence of which is different from the sequence of the ccpA gene of DSM32587, to obtain a ccpA-mutated DSM32587 strain;

c) determining the ratio beta-galactosidase activity as assayed by test D over the glucokinase activity as assayed by test E of the ccpA-mutated DSM32587 strain obtained in b), and selecting a ccpA-mutated DSM32587 strain presenting a ratio of at least $4 \cdot 10^{-6}$; and d) determining by test B the concentration of glucose in a milk fermented with said ccpA-mutated DSM32587 strain selected in c), wherein d1) a glucose concentration of at least 50 mM means that the mutated ccpA gene is according to the invention. In an embodiment, a mutated ccpA gene is considered to be according to the invention when the glucose concentration measured in step d) is at least 60 mM, at least 70 mM or at least 80 mM, or d2) an increase of the glucose concentration obtained with said ccpA-mutated DSM32587 strain selected in c) of at least 150% as compared to the glucose concentration obtained with DSM32587 strain, when both assayed by test B, means that the mutated ccpA gene is according to the invention. In an embodiment, a mutated ccpA gene is considered to be according to the invention when the glucose increase in step d) is at least 200% or at least 300% the glucose concentration of the DSM32587 strain.

In another example, the person skilled in the art can proceed by the following method to obtain and identify a mutated glcK gene according to the invention:

a) provide a DGCC7710 strain in which its ccpA gene has been replaced by the mutated ccpA gene as defined in SEQ ID NO:71 (ccpA$_{A14114-120}$), called herein DGCC7710-ccpA$_{A14114-120}$ strain;

b) carry out mutagenesis on the glcK gene of the DGCC7710-ccpA$_{A14114-120}$ strain in a), for example by random or directed mutagenesis, to obtain a glcK gene, the sequence of which is different from the sequence of the glcK gene of the DGCC7710-ccpA$_{A14114-120}$ strain, to obtain a glcK-mutated DGCC7710-ccpA$_{A14114-120}$ strain;

c) determining the ratio beta-galactosidase activity as assayed by test D over the glucokinase activity as assayed by test E of the glcK-mutated DGCC7710-ccpA$_{A14114-120}$ strain obtained in b), and selecting a glcK-mutated DGCC7710-ccpA$_{A14114-120}$ strain presenting a ratio of at least $4 \cdot 10^{-6}$; and d) determining by test B the concentration of glucose in a milk fermented with said glcK-mutated DGCC7710-ccpA$_{A14114-120}$ strain selected in c), wherein d1) a glucose concentration of at least 50 mM means that the mutated glck gene is according to the invention. In an embodiment, a mutated glck gene is considered to be according to the invention when the glucose concentration measured in step d) is at least 60 mM, at least 70 mM or at least 80 mM, or d2) an increase of the glucose concentration obtained with said glcK-mutated DGCC7710-ccpA$_{A14114-120}$ strain selected in c) of at least 150% as compared to the glucose concentration obtained with DGCC7710-ccpA$_{A14114-120}$ strain, when both assayed by test B, means that the mutated ccpA gene is according to the invention. In an embodiment, a mutated ccpA gene is considered to be according to the invention when the glucose increase in step d) is at least 200% or at least 300% the glucose concentration of the DGCC7710-ccpA$_{A14114-120}$ strain.

In this context, DGCC7710-ccpA$_{A14114-120}$ strain is the DGCC7710 strain into which its ccpA gene has been replaced by the ccpA gene as defined in SEQ ID NO:71.

Once identified, a mutated glcK gene and/or a mutated ccpA gene—as identified herein—can be introduced in lieu of the glcK gene and/or the ccpA gene of a lactose-positive, galactose-negative, *Streptococcus thermophilus* strain, to obtain a lactose-positive, galactose-negative, *Streptococcus thermophilus* strain of the invention.

IV. A Lactose-Positive, Galactose-Negative, *Streptococcus thermophilus* Strain of the Invention Carrying a Mutation in its lacZ Gene.

The invention is directed to a lactose-positive, galactose-negative, *Streptococcus thermophilus* strain carrying a mutation in the lacZ gene encoding a beta-galactosidase (hydrolysing lactose into galactose and glucose), wherein the ratio of the beta-galactosidase activity in said strain as assayed by test D over the glucokinase activity in said strain as assayed by test E is at least $4 \cdot 10^{-6}$ as defined herein.

Any mutation is appropriate, in particular any mutation which increases the lactose hydrolysis activity (i.e., beta-galactosidase activity) of said beta-galactosidase as compared to the corresponding strain not mutated in the lacZ gene. A mutation of the lacZ gene can also be identified by mutating the lacZ gene of the DGCC7710 strain, to obtain a lacZ-mutated DGCC7710 strain and comparing the beta-galactosidase activity in said lacZ-mutated DGCC7710 strain with the beta-galactosidase activity in the DGCC7710 strain, in particular when both strains have been assayed by test D. Thus, a lacZ mutation according to the invention can be obtained and identified by the following method:

a) provide the DGCC7710 strain;

b) carry out mutagenesis on the lacZ gene, to obtain a lacZ gene, the sequence of which is different from the sequence of the lacZ of DGCC7710, to obtain a lacZ-mutated DGCC7710 strain;

c) determining the beta-galactosidase activity in the lacZ-mutated DGCC7710 strain obtained in b) and independently of the DGCC7710 strain, both by test D, wherein a beta-galactosidase activity in the lacZ-mutated DGCC7710 strain higher than the beta-galactosidase activity in the DGCC7710 strain means that the lacZ gene is mutated according to the invention. By "higher beta-galactosidase activity", it is meant that the beta-galactosidase activity in the lacZ-mutated DGCC7710 strain as obtained in b) is at least 150%, at least 200% or at least 300% higher than the beta-galactosidase activity in the DGCC7710 strain, when both assayed by test D.

Once identified, the mutated lacZ gene according to the invention can be introduced in lieu of the lacZ gene of a lactose-positive, galactose-negative, *Streptococcus thermophilus* strain, to design a lactose-positive, galactose-negative, *Streptococcus thermophilus* strain of the invention.

Thus, though two *Streptococcus thermophilus* strains may differ by the sequence of their respective lacZ gene, this does not necessarily mean that one of these two lacZ genes is mutated in the sense of the invention. Indeed, are not considered as mutations within the present invention:

variations at the nucleotide level which do lead to a change at the protein level, but wherein this change does not impact the beta-galactosidase activity of the resulting beta-galactosidase as defined herein. Indeed, such variations can be observed at the level of the lacZ gene of the *Streptococcus thermophilus* of the invention without impacting the scope of protection.

Non-limitative examples of lacZ genes which are not considered as mutated in the sense of the invention are:
the polynucleotide encoding the beta-galactosidase as defined in SEQ ID NO:78 (Beta-Gal type ST1), in particular the polynucleotide as defined in SEQ ID NO:77; this Beta-Gal type is the one of DGCC7710 strain;
the lacZ polynucleotide encoding the beta-galactosidase as defined in SEQ ID NO: 80, 82, 84, 86, 88, 90, 92, 94, 96, 98, 100, 102, 104, 106, 108 and 110 (Beta-Gal type ST2 to ST13), in particular the lacZ polynucleotide as defined in SEQ ID NO: 79, 81, 83, 85, 87, 89, 91, 93, 95, 97, 99, 101, 103, 105, 107 and 109. The sequence of the beta-galactosidases as defined in SEQ ID NO: 80, 82, 84, 86, 88, 90, 92, 94, 96, 98, 100, 102, 104, 106, 108 and 110 is from 98.9 to 99.9% identical to SEQ ID NO:78.

In an embodiment, the *Streptococcus thermophilus* of the invention does not carry a mutation selected from the group consisting of a mutation leading to the knock-out of the lacZ gene and large deletions within the lacZ gene.

In an embodiment, the lactose-positive, galactose-negative *Streptococcus thermophilus* strain of the invention carries a mutation in a regulatory sequence, in particular in the promoter, of the lacZ gene leading to the transcriptional overexpression of the lacZ gene. Non-limitative examples of promoter sequences which can be mutated within the invention are disclosed in nucleotides 1 to 126 of the lacZ genes as defined in SEQ ID NO: 77, 79, 81, 83, 85, 87, 89, 91, 93, 95, 97, 99, 101, 103, 105, 107 and 109.

In an embodiment, the lactose-positive, galactose-negative *Streptococcus thermophilus* strain of the invention carries a mutation in the coding sequence of the lacZ gene leading to the substitution of an amino acid in the beta-galactosidase, such as having a beta-galactosidase activity increased as defined herein. In an embodiment, said substitution does not lead to a truncated beta-galactosidase. Non-limitative examples of lacZ coding sequences which can be mutated within the invention are disclosed in nucleotides 127 to 3231 of the lacZ genes as defined in SEQ ID NO: 77, 79, 81, 83, 85, 87, 89, 91, 93, 95, 97, 99, 101, 103, 105, 107 and 109.

The person skilled in the art is given, in this part of the application, further guidance on how to obtain and identify mutations of the lacZ gene. Based on the ratio defined above [beta-galactosidase activity in said strain as assayed by test D over the glucokinase activity in said strain as assayed by test E] together with a reference strain defined herein, the person skilled in the art would know how to identify a mutated lacZ gene according to the invention and to obtain a *Streptococcus thermophilus* of the invention.

Thus, the person skilled in the art can proceed by the following method:
a) provide a *Streptococcus thermophilus* strain, the lacZ gene of which is as defined in SEQ ID NO:77, such as the DGCC7710 strain;
b) carry out mutagenesis on the lacZ gene, for example by random or directed mutagenesis, to obtain a lacZ gene the sequence of which is different from the sequence of the lacZ gene of the strain in a);
c) insert the lacZ gene obtained in b) in lieu of the lacZ gene of the DGCC7710 strain, to obtain a DGCC7710 derivative;
d) determining the ratio beta-galactosidase activity as assayed by test D over the glucokinase activity as assayed by test E of said DGCC7710 derivative, wherein a ratio of at least $4 \cdot 10^{-6}$ as defined herein means that the inserted lacZ gene is a mutated lacZ gene according to the invention. In a particular embodiment, a mutated lacZ gene is considered to be according to the invention when the ratio beta-galactosidase activity as assayed by test D over the glucokinase activity as assayed by test E of said DGCC7710 derivative strain is at least $5 \cdot 10^{-6}$, at least $6 \cdot 10^{-6}$, at least $7 \cdot 10^{-6}$ or at least $8 \cdot 10^{-6}$. In an embodiment, said ratio is less than $8 \cdot 10^{-3}$.

In an embodiment, the person skilled in the art can proceed by the following method:
a) provide a *Streptococcus thermophilus* strain, the promoter sequence of the lacZ gene of which is as defined in nucleotides 1 to 126 of SEQ ID NO:77, such as the DGCC7710 strain;
b) carry out mutagenesis on the lacZ gene, for example by random or directed mutagenesis, to obtain a promoter sequence of the lacZ gene the sequence of which is different from the promoter sequence of the lacZ gene of the strain in a);
c) insert the promoter-mutated lacZ gene obtained in b) in lieu of the promoter of the lacZ gene of the DGCC7710 strain, to obtain a DGCC7710 derivative;
d) determining the ratio beta-galactosidase activity as assayed by test D over the glucokinase activity as assayed by test E of said DGCC7710 derivative, wherein a ratio of at least $4 \cdot 10^{-6}$ as defined herein means that the inserted promoter of lacZ gene is a mutated promoter of lacZ gene according to the invention. In a particular embodiment, a mutated promoter of lacZ gene is considered to be according to the invention when the ratio beta-galactosidase activity as assayed by test D over the glucokinase activity as assayed by test E of said DGCC7710 derivative strain is at least $5 \cdot 10^{-6}$, at least $6 \cdot 10^{-6}$, at least $7 \cdot 10^{-6}$ or at least $8 \cdot 10^{-6}$. In an embodiment, said ratio is less than $8 \cdot 10^{-3}$.

Once identified, a mutated lacZ gene, in particular a mutated promoter of lacZ gene,—as identified herein—can be introduced in lieu of the lacZ gene, in particular in lieu of the promoter of lacZ gene, of a lactose-positive, galactose-negative, *Streptococcus thermophilus* strain, to obtain a lactose-positive, galactose-negative, *Streptococcus thermophilus* strain of the invention.

V. A Lactose-Positive, Galactose-Negative, *Streptococcus thermophilus* Strain of the Invention Carrying a Mutation in its ptsH Gene The invention is directed to a lactose-positive, galactose-negative, *Streptococcus thermophilus* strain carrying a mutation in the ptsH gene encoding the HPr protein, wherein the ratio of the beta-galactosidase activity in said strain as assayed by test D over the glucokinase activity in said strain as assayed by test E is at least $4 \cdot 10^{-6}$ as defined herein.

Any mutation is appropriate as long as the beta-galactosidase activity in said strain as assayed by test D over the glucokinase activity in said strain as assayed by test E is at least $4 \cdot 10^{-6}$ as defined herein.

Thus, though two *Streptococcus thermophilus* strains may differ by the sequence of their respective ptsH gene, this does not necessarily mean that one of these two ptsH genes is mutated in the sense of the invention. Indeed, are not considered as mutations within the present invention:
variations at the nucleotide level which do lead to a change at the protein level, but wherein this change does not impact the activity of the resulting HPr protein. Indeed, such variations can be observed at the level of the ptsH gene of the *Streptococcus thermophilus* of the invention without impacting the scope of protection.

Non-limitative examples of ptsH genes which are not considered as mutated in the sense of the invention are:
the polynucleotide encoding the HPr protein as defined in SEQ ID NO:112 (HPr type ST1), in particular the polynucleotide as defined in SEQ ID NO:111; this HPr type is the one of DGCC7710 strain;
the ptsH polynucleotide encoding the HPr protein as defined in SEQ ID NO: 114, 116, 118 and 120 (HPr type ST2 to 5), in particular the polynucleotide as defined in SEQ ID NO:113, 115, 117 and 119. The sequence of the HPr proteins as defined in SEQ ID NO: 114, 116, 118 and 120 is from 96.5 to 98.8% identical to SEQ ID NO:112.

In an embodiment, the ptsH gene mutation is not a mutation leading to the knock-out (i.e., the complete disruption) of the ptsH gene.

In an embodiment, the mutation is introduced into the coding sequence of the ptsH gene.

In an embodiment, the mutation is a mutation in the coding sequence of the ptsH gene, leading to a truncated HPr protein. Whatever the position of the truncation, the mutation introduced into the ptsH gene is either a nucleotide substitution leading to a STOP codon or a deletion, insertion or deletion/insertion leading to a frameshift of the open reading frame and a premature STOP codon. In an embodiment, the mutation introduced into the ptsH gene is a nucleotide substitution leading to a STOP codon. In an embodiment, the mutation introduced into the ptsH gene is a deletion, insertion or deletion/insertion leading to a frameshift of the open reading frame and a premature STOP codon In an embodiment, the mutation is a mutation in the coding sequence of the ptsH gene, leading to the substitution of an amino acid by another amino acid.

The person skilled in the art is given, in this part of the application, further guidance on how to obtain and identify mutations of the ptsH gene. Based on the ratio defined above [beta-galactosidase activity in said strain as assayed by test D over the glucokinase activity in said strain as assayed by test E] together with a reference strain defined herein, the person skilled in the art would know how to identify a mutated ptsH gene according to the invention and to obtain a *Streptococcus thermophilus* of the invention.

Thus, the person skilled in the art can proceed by the following method:
a) provide a *Streptococcus thermophilus* strain, the ptsH gene of which is as defined in SEQ ID NO:111, such as the DGCC7710 strain;
b) carry out mutagenesis on the ptsH gene, for example by random or directed mutagenesis, to obtain a ptsH gene the sequence of which is different from the sequence of the ptsH gene of the strain in a);
c) insert the ptsH gene obtained in b) in lieu of the ptsH gene of the DGCC7710 strain, to obtain a DGCC7710 derivative; and
d) determining the ratio beta-galactosidase activity as assayed by test D over the glucokinase activity as assayed by test E of said DGCC7710 derivative, wherein a ratio of at least $4 \cdot 10^{-6}$ as defined herein means that the inserted ptsH gene is a mutated ptsH gene according to the invention. In a particular embodiment, a mutated ptsH gene is considered to be according to the invention when the ratio beta-galactosidase activity as assayed by test D over the glucokinase activity as assayed by test E of said DGCC7710 derivative is at least $5 \cdot 10^{-6}$, at least $6 \cdot 10^{-6}$, at least $7 \cdot 10^{-6}$ or at least $8 \cdot 10^{-6}$. In an embodiment, said ratio is less than $8 \cdot 10^{-3}$.

Once identified, a mutated ptsH gene as identified herein—can be introduced in lieu of the ptsH gene of a lactose-positive, galactose-negative, *Streptococcus thermophilus* strain, to obtain a lactose-positive, galactose-negative, *Streptococcus thermophilus* strain of the invention.

VI. A Lactose-Positive, Galactose-Negative, *Streptococcus thermophilus* Strain of the Invention According to any One of the Embodiments I to V, Further Carrying a Mutation in a Gene Encoding a Protein of the Mannose-Glucose-Specific PTS.

In addition to any of the mutations disclosed above, as such or combined, the inventors have shown that additional mutations of genes in the lactose-positive, galactose-negative, *Streptococcus thermophilus* strains of the invention significantly increase the level of glucose release during dairy fermentation. The inventors have shown that the introduction of a mutated gene encoding a protein of the mannose-glucose-specific PTS, in particular a mutated manL gene, a mutated manM gene or a mutated manN gene, into a *Streptococcus thermophilus* as defined under I to V above, leads to a synergy with regards to the release of glucose, i.e. the concentration of glucose released is far more than the addition of the glucose concentration released using a *Streptococcus thermophilus* as defined under I to V above and the glucose concentration released using a *Streptococcus thermophilus* mutated only in said gene encoding a protein of the mannose-glucose-specific PTS.

Thus, the invention is directed to a lactose-positive, galactose-negative, *Streptococcus thermophilus* strain selected from the group consisting of a lactose-positive, galactose-negative, *Streptococcus thermophilus* strain as defined under I, a lactose-positive, galactose-negative, *Streptococcus thermophilus* strain as defined under II, a lactose-positive, galactose-negative, *Streptococcus thermophilus* strain as defined under III, a lactose-positive, galactose-negative, *Streptococcus thermophilus* strain as defined under IV and a lactose-positive, galactose-negative, *Streptococcus thermophilus* strain as defined under V, which is further mutated in one or more genes, in particular one gene, encoding a protein of the mannose-glucose-specific PTS. In an embodiment, the gene encoding a protein of the mannose-glucose-specific PTS is the manL gene, the manM gene, the manN gene or the manO gene. In an embodiment, the gene encoding a protein of the mannose-glucose-specific PTS is the manL gene, the manM gene, the manN gene or the manO gene. In an embodiment, the gene encoding a protein of the mannose-glucose-specific PTS is the manL gene, the manM gene or the manN gene.

By "mutated/mutation in one or more genes, in particular one gene, encoding a protein of the mannose-glucose-specific PTS", it is meant that the lactose-positive, galactose-negative, *Streptococcus thermophilus* strain carries a mutation in one, two or three genes selected from the group consisting of the manL gene, the manM gene, the manN gene and the manO gene. In an embodiment, the lactose-positive, galactose-negative, *Streptococcus thermophilus* strain carries a mutation in one, two or three genes selected from the group consisting of the manL gene, the manM gene and the manN gene. In an embodiment, the lactose-positive, galactose-negative, *Streptococcus thermophilus* strain of the invention carries a mutation in manL. In an embodiment, the lactose-positive, galactose-negative, *Streptococcus thermophilus* strain of the invention carries a mutation in manM. In an embodiment, the lactose-positive, galactose-negative, Streptococcus thermophilus strain of the invention carries a mutation in manN. In an embodiment, the lactose-positive, galactose-negative, Streptococcus thermophilus strain of the invention carries a mutation in manL and a mutation in manM. In an embodiment, the lactose-positive, galactose-negative, Streptococcus thermophilus strain of the invention carries a mutation in manL and a mutation in manN. In an embodiment, the lactose-positive, galactose-negative, Streptococcus thermophilus strain of the invention carries a mutation in manM and a mutation in manN. In an embodiment, the lactose-positive, galactose-negative, Streptococcus thermophilus strain of the invention carries a mutation in manL, a mutation in manM and a mutation in manN.

In an embodiment, the invention is directed to a lactose-positive, galactose-negative, Streptococcus thermophilus strain carrying a mutation in the glcK gene encoding a glucokinase, the glucokinase activity of which in said strain is significantly reduced but not null as defined herein and carrying a mutation in one or more genes, in particular one gene, encoding a protein of the mannose-glucose-specific PTS, wherein the ratio of the beta-galactosidase activity in said strain as assayed by test D over the glucokinase activity in said strain as assayed by test E is at least $4·10^{-6}$ as defined herein. In an embodiment, the one or more genes, in particular the gene, encoding a protein of the mannose-glucose-specific PTS is the manL gene, the manM gene and/or the manN gene.

In an embodiment, the invention is directed to a lactose-positive, galactose-negative, Streptococcus thermophilus strain carrying a mutation in the ccpA gene as defined herein and carrying a mutation in one or more genes, in particular one gene, encoding a protein of the mannose-glucose-specific PTS, wherein the ratio of the beta-galactosidase activity in said strain as assayed by test D over the glucokinase activity in said strain as assayed by test E is at least $4·10^{-6}$ as defined herein. In an embodiment, the one or more genes, in particular the gene, encoding a protein of the mannose-glucose-specific PTS is the manL gene, the manM gene and/or the manN gene.

In an embodiment, the invention is directed to a lactose-positive, galactose-negative, Streptococcus thermophilus strain carrying a mutation in the glcK gene encoding a glucokinase, the glucokinase activity of which in said strain is significantly reduced but not null, as defined herein, carrying a mutation in its ccpA gene as defined herein and carrying a mutation in one or more genes, in particular one gene, encoding a protein of the mannose-glucose-specific PTS, wherein the ratio of the beta-galactosidase activity in said strain as assayed by test D over the glucokinase activity in said strain as assayed by test E is at least $4·10^{-6}$ as defined herein. In an embodiment, the one or more genes, in particular the gene, encoding a protein of the mannose-glucose-specific PTS is the manL gene, the manM gene and/or the manN gene.

In an embodiment, the invention is directed to a lactose-positive, galactose-negative, Streptococcus thermophilus strain carrying a mutation in the lacZ gene as defined herein and carrying a mutation in a gene encoding a protein of the mannose-glucose-specific PTS, wherein the ratio of the beta-galactosidase activity in said strain as assayed by test D over the glucokinase activity in said strain as assayed by test E is at least $4·10^{-6}$ as defined herein. In an embodiment, the one or more genes, in particular the gene, encoding a protein of the mannose-glucose-specific PTS is the manL gene, the manM gene and/or the manN gene.

In an embodiment, the invention is directed to a lactose-positive, galactose-negative, Streptococcus thermophilus strain carrying a mutation in the ptsH gene as defined herein and carrying a mutation in a gene encoding a protein of the mannose-glucose-specific PTS, wherein the ratio of the beta-galactosidase activity in said strain as assayed by test D over the glucokinase activity in said strain as assayed by test E is at least $4·10^{-6}$ as defined herein. In an embodiment, the one or more genes, in particular the gene, encoding a protein of the mannose-glucose-specific PTS is the manL gene, the manM gene and/or the manN gene.

As far as the mutation(s) in the glcK gene, the ccpA gene, the combination of the glcK gene and the ccpA gene, the lacZ gene or the ptsH gene are concerned, any of the embodiments disclosed above under I to V applies similarly to the lactose-positive, galactose-negative, Streptococcus thermophilus strain further carrying a mutation in a gene encoding a protein of the mannose-glucose-specific PTS of the invention, as long as the obtained lactose-positive, galactose-negative, Streptococcus thermophilus strain leads to a ratio of the beta-galactosidase activity in said strain as assayed by test D over the glucokinase activity in said strain as assayed by test E is at least $4·10^{-6}$ as defined herein As far as the mutation in a gene encoding a protein of the mannose-glucose-specific PTS is concerned, any mutation is appropriate, in particular any mutation which reduces or abolishes the import of glucose from the medium into the bacteria. Such a mutation can be obtained and identified by introducing a gene encoding a protein of the mannose-glucose-specific PTS into any of the strains of the invention disclosed above under I to V, and determining by test B the concentration of glucose in a milk fermented with said strain, wherein an increase of glucose concentration as compared to the strain of the invention under I to V means that the gene encoding a protein of the mannose-glucose-specific PTS is mutated according to the invention.

In an embodiment, the mutation of the gene encoding a protein of the mannose-glucose-specific PTS, in particular of the manL gene, manM gene or manN gene, is a mutation leading to the knock-out (i.e., the complete disruption) of the gene.

In an embodiment, the mutation of the gene encoding a protein of the mannose-glucose-specific PTS, in particular of the manL gene, manM gene or manN gene, is a mutation of the promoter of the gene, in particular a mutation of the promoter of the gene reducing or inhibiting the transcription of the gene.

In an embodiment, the mutation of the gene encoding a protein of the mannose-glucose-specific PTS, in particular of the manL gene, manM gene or manN gene, is a mutation introduced into the coding sequence of the gene, in particular a mutation leading to the reduction or abolition of the glucose import activity of the protein encoded by the mutated gene, in particular to the reduction or abolition of the glucose import activity of the $IIAB^{Man}$ protein, $IIC^{Man}$ protein or $IID^{Man}$ protein.

In an embodiment, the mutation of the gene encoding a protein of the mannose-glucose-specific PTS, in particular of the manL gene, manM gene or manN gene is a mutation in the coding sequence of the gene, leading to a truncated protein, in particular to a truncated $IIAB^{Man}$ protein, a truncated $IIC^{Man}$ protein or a truncated $IID^{Man}$ protein respectively, in particular to a truncated protein (such as a truncated $IIAB^{Man}$ protein, a truncated $IIC^{Man}$ protein or a truncated $IID^{Man}$ protein) having a reduced or abolished glucose import activity. Whatever the position of the truncation, the mutation introduced into the gene is either a nucleotide substitution leading to a STOP codon or a deletion, insertion or deletion/insertion leading to a frameshift of the open reading frame and a premature STOP codon. In an embodiment, the mutation introduced into the gene is a nucleotide substitution leading to a STOP codon. In an embodiment, the mutation introduced into the gene is a deletion, insertion or deletion/insertion leading to a frameshift of the open reading frame and a premature STOP codon.

Though two *Streptococcus thermophilus* strains may differ by the sequence of their respective manL, manM or ManN gene, this does not necessarily mean that one of these genes is mutated in the sense of the invention. Indeed, are not considered as mutations of the manL, manM or ManN gene gene within the present invention:

- variations at the nucleotide level which do not lead to any change at the protein level (silent variation) and which do not impact the translation of the manL, manM or ManN RNA;
- variations at the nucleotide level which do lead to a change at the protein level, but wherein this change does not lead to a decrease or abolition of the glucose import activity of the protein of the mannose-glucose-specific PTS; and
- variations at the nucleotide level which do lead to a change at the protein level, but wherein this change does not enable to increase the level of glucose release when introduced in any of the strains of the invention disclosed above under I to V.

Non-limitative examples of manL, manM and ManN genes (respectively encoding the IIAB$^{Man}$ protein, the IIC$^{Man}$ protein and the IID$^{Man}$ protein) which are not considered as mutated in the sense of the invention are:

- the polynucleotide encoding the IIAB$^{Man}$ protein as defined in SEQ ID NO:122 (IIAB$^{Man}$ type ST1), in particular the polynucleotide as defined in SEQ ID NO:121; this IIAB$^{Man}$ type is the one of DGCC7710 strain;
- the manL polynucleotide encoding respectively the IIAB$^{Man}$ protein as defined in SEQ ID NO:124, 126, 128, 130, 132, 134, 136, 138, 140, 142, 144, 146, 148, 150, 152 and 154 (IIAB$^{Man}$ type ST2 to ST17), in particular the polynucleotide as defined in SEQ ID NO:121, 123, 125, 127, 129, 131, 133, 135, 137, 139, 141, 143, 145, 147, 149, 151 and 153. The sequence of the IIAB$^{Man}$ proteins as defined in SEQ ID NO: 124, 126, 128, 130, 132, 134, 136, 138, 140, 142, 144, 146, 148, 150, 152 and 154 is from 98.4 to 99.6% identical to SEQ ID NO:122.
- the polynucleotide encoding the IIC$^{Man}$ protein as defined in SEQ ID NO:174 (IIC$^{Man}$ type ST1), in particular the polynucleotide as defined in SEQ ID NO:173; this IIC$^{Man}$ type is the one of DGCC7710 strain;
- the manM polynucleotide encoding respectively the IIC$^{Man}$ protein as defined in SEQ ID NO: 176, 178, 180, 182, 184, 186, 188, 190, 192, 194, 196, 198 and 200 (IIC$^{Man}$ type ST2 to ST14), in particular the polynucleotide as defined in SEQ ID NO:175, 177, 179, 181, 183, 185, 187, 189, 191, 193, 195, 197 and 199. The sequence of the IIC$^{Man}$ proteins as defined in SEQ ID NO: 176, 178, 180, 182, 184, 186, 188, 190, 192, 194, 196, 198 and 200 is from 98.5 to 99.6% identical to SEQ ID NO:174.
- the polynucleotide encoding the IID$^{Man}$ protein as defined in SEQ ID NO:211 (IID$^{Man}$ type ST1), in particular the polynucleotide as defined in SEQ ID NO:210; this IID$^{Man}$ type is the one of DGCC7710;
- the manN polynucleotide encoding respectively the IID$^{Man}$ protein as defined in SEQ ID NO: 213, 215, 217, 219, 221, 223, 225, 227, 229, 231, 233, 235, 237, 239, 241, 243, 245, 247 and 249 (IID$^{Man}$ type ST2 to ST20), in particular the polynucleotide as defined in SEQ ID NO:212, 214, 216, 218, 220, 222, 224, 226, 228, 230, 232, 234, 236, 238, 240, 242, 244, 246 and 248. The sequence of the IID$^{Man}$ proteins as defined in SEQ ID NO: 213, 215, 217, 219, 221, 223, 225, 227, 229, 231, 233, 235, 237, 239, 241, 243, 245, 247 and 249 is from 97.3 to 99.6% identical to SEQ ID NO:210.

The inventors have identified at least one mutation in the manL gene, which when inserted into the manL gene of an original lactose-positive, galactose-negative, *Streptococcus thermophilus* strain [mutated in the glcK gene, the ccpA gene, both the glcK gene and the ccpA gene, the lacZ gene or the ptsH gene and having a ratio of the beta-galactosidase activity in said strain as assayed by test D over the glucokinase activity in said strain as assayed by test E of said strain of at least $4 \cdot 10^{-6}$ as defined herein, such as any of the strains of the invention disclosed above under I to V], enables to increase the glucose concentration as compared to the original strain, when assayed by test B.

Thus, the invention is directed to a lactose-positive, galactose-negative, *Streptococcus thermophilus* strain carrying a mutation in the glcK gene, the ccpA gene, both the glcK gene and the ccpA gene, the lacZ gene or the ptsH gene, and a mutation in the manL gene, wherein the ratio of the beta-galactosidase activity in said strain as assayed by test D over the glucokinase activity in said strain as assayed by test E is at least $4 \cdot 10^{-6}$ as defined herein. In an embodiment, the mutation in the manL gene leads to the truncation of the IIAB$^{Man}$ protein at position 305. In an embodiment, the mutation in the manL gene is the substitution of the nucleotide G in the nucleotide T at position 916 (leading to a stop codon at position 306). A *Streptococcus thermophilus* IIAB$^{Man}$ protein truncated at position 305 is referred herein as IIAB$^{Man}_{305}$.

In an embodiment, the sequence of said IIAB$^{Man}$ protein truncated in position 305 is selected from the group consisting of:
a) a sequence as defined in SEQ ID NO:156; and
b) a IIAB$^{Man}$ variant sequence having at least 90% similarity or identity with SEQ ID NO:156, in particular being 305 amino acids in length.

For the definition of the IIAB$^{Man}$ variant having at least 90% similarity or identity with SEQ ID NO:156, the similarity or identity is calculated herein over the whole length of the 2 sequences after optimal alignment [i.e., number of similar or identical amino acid residues in the aligned parts(s) of the sequences]. In an embodiment, the IIAB$^{Man}$ variant sequence has at least 91, 92, 93, 94, 95, 96, 97, 98 or 99% similarity or identity with SEQ ID NO:156. In an embodiment, the IIAB$^{Man}$ variant sequence has at least 95% similarity or identity with SEQ ID NO:156. In an embodiment, the IIAB$^{Man}$ variant sequence has at least 97% similarity or identity with SEQ ID NO:156. In an embodiment, the IIAB$^{Man}$ variant sequence has at least 98% similarity or identity with SEQ ID NO:156.

In a particular embodiment, the IIAB$^{Man}$ variant sequence differs from SEQ ID NO: 156 by from 1 to 30 amino acid substitutions. In a particular embodiment, the IIAB$^{Man}$ variant sequence differs from SEQ ID NO: 156 by from 1 to 20 amino acid substitutions. In a particular embodiment, the IIAB$^{Man}$ variant sequence differs from SEQ ID NO: 156 by from 1 to 15 amino acid substitutions. In a particular embodiment, the IIAB$^{Man}$ variant sequence differs from SEQ ID NO: 156 by from 1 to 10 amino acid substitutions. In a particular embodiment, the IIAB$^{Man}$ variant sequence differs from SEQ ID NO: 156 by 1, 2, 3, 4, 5, 6, 7, 8, 9 or 10 amino acid substitutions. In an embodiment, the sequence of the IIAB$^{Man}$ protein of the lactose-positive, galactose-negative Streptococcus thermophilus strain of the invention is selected from the group consisting of SEQ ID NOs: 156 to 172.

In an embodiment, the manL gene carried by the Streptococcus thermophilus strain of the invention encodes a IIAB$^{Man}$ protein, the sequence of which is selected from the group consisting of SEQ ID NO:156 and any IIAB$^{Man}$ variant sequence having at least 90% similarity or identity with SEQ ID NO:156 as defined herein (in particular SEQ ID NO:157 to 172). In an embodiment, the manL gene carried by the Streptococcus thermophilus strain of the invention is as defined in SEQ ID NO:155.

The inventors have identified at least one mutation in the manM gene, which when inserted into the manL gene of an original lactose-positive, galactose-negative, Streptococcus thermophilus strain [mutated in the glcK gene, the ccpA gene, both the glcK gene and the ccpA gene, the lacZ gene or the ptsH gene and having a ratio of the beta-galactosidase activity in said strain as assayed by test D over the glucokinase activity in said strain as assayed by test E of said strain of at least 4·10$^{-6}$ as defined herein, such as any of the strains of the invention disclosed above under I to V], enables to increase the glucose concentration as compared to the original strain, concentration when assayed by test B.

Thus, the invention is directed to a lactose-positive, galactose-negative, Streptococcus thermophilus strain carrying a mutation in the glcK gene, the ccpA gene, both the glcK gene and the ccpA gene, the lacZ gene or the ptsH gene, and a mutation in the manM gene, wherein the ratio of the beta-galactosidase activity in said strain as assayed by test D over the glucokinase activity in said strain as assayed by test E is at least 4·10$^{-6}$ as defined herein. In an embodiment, the mutation in the manM gene leads to the truncation of the IIC$^{Man}$ protein at position 208. In an embodiment, the mutation in the manM gene is the substitution of the nucleotide G in the nucleotide T at position 625 (leading to a stop codon at position 209). A Streptococcus thermophilus IIC$^{Man}$ protein truncated at position 208 is referred herein as IIC$^{Man}_{208}$.

In an embodiment, the sequence of said IIC$^{Man}$ protein truncated in position 208 is selected from the group consisting of:
  a) a sequence as defined in SEQ ID NO:202; and
  b) a IIC$^{Man}$ variant sequence having at least 90% similarity or identity with SEQ ID NO: 202, in particular being 208 amino acids in length.

For the definition of the IIC$^{Man}$ variant having at least 90% similarity or identity with SEQ ID NO: 202, the similarity or identity is calculated herein over the whole length of the 2 sequences after optimal alignment [i.e., number of similar or identical amino acid residues in the aligned parts(s) of the sequences]. In an embodiment, the IIC$^{Man}$ variant sequence has at least 91, 92, 93, 94, 95, 96, 97, 98 or 99% similarity or identity with SEQ ID NO: 202. In an embodiment, the IIC$^{Man}$ variant sequence has at least 95% similarity or identity with SEQ ID NO: 202. In an embodiment, the IIC$^{Man}$ variant sequence has at least 97% similarity or identity with SEQ ID NO: 202. In an embodiment, the IIC$^{Man}$ variant sequence has at least 98% similarity or identity with SEQ ID NO: 202.

In a particular embodiment, the IIC$^{Man}$ variant sequence differs from SEQ ID NO: 202 by from 1 to 30 amino acid substitutions. In a particular embodiment, the IIC$^{Man}$ variant sequence differs from SEQ ID NO: 202 by from 1 to 20 amino acid substitutions. In a particular embodiment, the IIC$^{Man}$ variant sequence differs from SEQ ID NO: 202 by from 1 to 15 amino acid substitutions. In a particular embodiment, the IIC$^{Man}$ variant sequence differs from SEQ ID NO: 202 by from 1 to 10 amino acid substitutions. In a particular embodiment, the IIC$^{Man}$ variant sequence differs from SEQ ID NO: 202 by 1, 2, 3, 4, 5, 6, 7, 8, 9 or 10 amino acid substitutions. In an embodiment, the sequence of the IIC$^{Man}$ protein of the lactose-positive, galactose-negative Streptococcus thermophilus strain of the invention is selected from the group consisting of SEQ ID NOs: 202 to 209.

In an embodiment, the manM gene carried by the Streptococcus thermophilus strain of the invention encodes a IIC$^{Man}$ protein, the sequence of which is selected from the group consisting of SEQ ID NO: 202 and any IIC$^{Man}$ variant sequence having at least 90% similarity or identity with SEQ ID NO:202 as defined herein (in particular SEQ ID NO: 203 to 209). In an embodiment, the manM gene carried by the Streptococcus thermophilus strain of the invention is as defined in SEQ ID NO:201.

The inventors have identified at least one mutation in the manN gene, which when inserted into the manN gene of an original lactose-positive, galactose-negative, Streptococcus thermophilus strain [mutated in the glcK gene, the ccpA gene, both the glcK gene and the ccpA gene, the lacZ gene or the ptsH gene and having a ratio of the beta-galactosidase activity in said strain as assayed by test D over the glucokinase activity in said strain as assayed by test E of said strain of at least 4·10$^{-6}$ as defined herein, such as any of the strains of the invention disclosed above under I to V], enables to increase the glucose concentration as compared to the original strain, concentration when assayed by test B.

Thus, the invention is directed to a lactose-positive, galactose-negative, Streptococcus thermophilus strain carrying a mutation in the glcK gene, the ccpA gene, both the glcK gene and the ccpA gene, the lacZ gene or the ptsH gene, and a mutation in the manN gene, wherein the ratio of the beta-galactosidase activity in said strain as assayed by test D over the glucokinase activity in said strain as assayed by test E is at least 4·10$^{-6}$ as defined herein. In an embodiment, the mutation in the manN gene leads to the truncation of the IID$^{Man}$ protein at position 28. In an embodiment, the mutation in the manN gene is an insertion of a nucleotide A in the stretch of 5 nucleotides A at positions 37-41 (leading to a stretch of 6 nucleotides A, a frameshift and a truncation of the IID$^{Man}$ protein at position 28). This Streptococcus thermophilus IID$^{Man}$ protein truncated at position 28 is referred herein as IID$^{Man}_{28}$.

In an embodiment, the sequence of said IID$^{Man}$ protein truncated in position 28 is selected from the group consisting of:
  a) a sequence as defined in SEQ ID NO:251; and
  b) a IID$^{Man}$ variant sequence having at least 90% similarity or identity with SEQ ID NO: 251, in particular being 28 amino acids in length.

For the definition of the IID$^{Man}$ variant having at least 90% similarity or identity with SEQ ID NO: 251, the similarity or identity is calculated herein over the whole length of the 2 sequences after optimal alignment [i.e., number of similar or identical amino acid residues in the aligned parts(s) of the sequences]. In an embodiment, the IID$^{Man}$ variant sequence has at least 91, 92, 93, 94, 95, 96, 97, 98 or 99% similarity or identity with SEQ ID NO: 251. In an embodiment, the IID$^{Man}$ variant sequence has at least 95% similarity or identity with SEQ ID NO: 251. In an embodiment, the IID$^{Man}$ variant sequence has at least 96% similarity or identity with SEQ ID NO: 251. In an embodiment, the IID$^{Man}$ variant sequence has at least 97% similarity or identity with SEQ ID NO: 251.

In a particular embodiment, the IID$^{Man}$ variant sequence differs from SEQ ID NO: 251 by from 1 to 10 amino acid substitutions. In a particular embodiment, the IID$^{Man}$ variant sequence differs from SEQ ID NO: 251 by 1, 2, 3, 4, 5, 6, 7, 8, 9 or 10 amino acid substitutions. In an embodiment, the sequence of the IID$^{Man}$ protein of the lactose-positive, galactose-negative Streptococcus thermophilus strain of the invention is selected from the group consisting of SEQ ID NOs: 251 to 255.

In an embodiment, the manN gene carried by the Streptococcus thermophilus strain of the invention encodes a IID$^{Man}$ protein, the sequence of which is selected from the group consisting of SEQ ID NO: 251 and any IID$^{Man}$ variant sequence having at least 90% similarity or identity with SEQ ID NO: 251 as defined herein (in particular SEQ ID NO:252 to 255). In an embodiment, the manN gene carried by the Streptococcus thermophilus strain of the invention is selected from the group consisting of SEQ ID NO: 250.

In addition to be characterized by a ratio beta-galactosidase activity in said strain as assayed by test D over the glucokinase activity in said strain as assayed by test E of at least 4·10$^{-6}$ as defined herein, the lactose-positive, galactose-negative, Streptococcus thermophilus strain of the invention further mutated in a gene encoding a protein of the mannose-glucose-specific PTS (defined under VI herein) can be further characterized by its ability to release glucose when used to ferment milk.

Thus, the lactose-positive, galactose-negative, Streptococcus thermophilus strain, further mutated in a gene encoding a protein of the mannose-glucose-specific PTS (defined under VI herein), is further characterized by the fact that the concentration of glucose in a milk fermented with said Streptococcus thermophilus strain as assayed by test B, is at least 80 mM. In a particular embodiment, the concentration of glucose in a milk fermented with said Streptococcus thermophilus strain as assayed by test B, is at least 90 mM. In a particular embodiment, the concentration of glucose in a milk fermented with said Streptococcus thermophilus strain as assayed by test B, is at least 100 mM. In a particular embodiment, the concentration of glucose in a milk fermented with said Streptococcus thermophilus strain as assayed by test B is selected from the group consisting of a concentration with is at least 80 mM, at least 90 mM, and at least 100 mM.

Any method can be used to identify a mutation in a gene encoding a protein of the mannose-glucose-specific PTS, in particular in the manL gene, manM gene or manN gene suitable within the lactose-positive, galactose-negative, Streptococcus thermophilus strain of the invention.

As an example, to obtain and identify a suitable mutation in the manL gene, manM gene or manN gene, the person skilled in the art can proceed by the following method:
a) provide the DSM32587 strain (mutated in its glcK gene)
b) carry out mutagenesis on the manL, manM or manN gene of the strain in a), for example by random or directed mutagenesis, to obtain a manL, manM or manN gene, the sequence of which is different from the sequence of the manL, manM or manN gene of DSM32587, to obtain a man-mutated DSM32587 strain;
c) determining the ratio beta-galactosidase activity as assayed by test D over the glucokinase activity as assayed by test E of the man-mutated DSM32587 strain obtained in b), and selecting a man-mutated DSM32587 strain presenting a ratio of at least 4·10$^{-6}$ as defined herein; and
d) determining by test B the concentration of glucose in a milk fermented with said man-mutated DSM32587 strain selected in c), wherein
   d1) a glucose concentration of at least 80 mM means that the mutated manL, manM or manN gene is according to the invention. In an embodiment, a mutated manL, manM or manN gene is considered to be according to the invention when the glucose concentration measured in step d) is at least 90 mM or at least 100 mM, or
   d2) an increase of the glucose concentration obtained with the man-mutated DSM32587 strain selected in c) as compared to the DSM32587 strain, means that the mutated manL, manM or manN gene is according to the invention.

Alternatively, the person skilled in the art can proceed by the following method:
a) provide a DGCC7710 strain in which its ccpA gene has been replaced by the mutated ccpA gene as defined in SEQ ID NO:71 (ccpA$_{A14114-120}$), called herein DGCC7710-ccpA$_{A14114-120}$ strain;
b) carry out mutagenesis on the manL, manM or manN gene of the strain in a), for example by random or directed mutagenesis, to obtain a manL, manM or manN gene, the sequence of which is different from the sequence of the manL, manM or manN gene of the DGCC7710-ccpA$_{A14114-120}$ strain, to obtain a man-mutated DGCC7710-ccpA$_{A14114-120}$ strain;
c) determining the ratio beta-galactosidase activity as assayed by test D over the glucokinase activity as assayed by test E of the man-mutated DGCC7710-ccpA$_{A14114-120}$ strain obtained in b), and selecting a man-mutated DGCC7710-ccpA$_{A14114-120}$ strain presenting a ratio of at least 4·10$^{-6}$ as defined herein; and
d) determining by test B the concentration of glucose in a milk fermented with said man-mutated DGCC7710-ccpA$_{A14114-120}$ strain selected in c), wherein
   d1) a glucose concentration of at least 80 mM means that the mutated manL, manM or manN gene is according to the invention. In an embodiment, a mutated manL, manM or manN gene is considered to be according to the invention when the glucose concentration measured in step d) is at least 90 mM or at least 100 mM; or
   d2) an increase of the glucose concentration obtained with the man-mutated DGCC7710-ccpA$_{A14114-120}$ strain selected in c) as compared to the DGCC7710-ccpA$_{A14114-120}$ strain, means that the mutated manL, manM or manN gene is according to the invention.

In the above method, the expression "increase the glucose concentration" or "increase of the glucose concentration" as compared to a reference [original] strain in step d) means a glucose concentration of the tested strain which is at least 150%, at least 200%, at least 300%, at least 400% or at least 500% the glucose concentration of the reference [original] strain, when both strains are assayed by test B.

In an embodiment, the expression "increase of the glucose concentration" as compared to the DSM32587 strain in step d) means a glucose concentration of the tested strain [mutated in the manL, manM or manN gene] which is at least 150%, at least 200% or at least 300%, the glucose concentration of the DSM32587 strain, when both strains are assayed by test B.

In an embodiment, the expression "increase of the glucose concentration" as compared to the DGCC7710-ccpA$_{A14114-120}$ derivative in step d) means a glucose concentration of the tested strain [mutated in the manL, manM or manN gene] which is at least 150%, at least 200%, at least 300%, at least 400% or at least 500% the glucose concentration of the DGCC7710-ccpA$_{A14114-120}$ derivative, when both strains are assayed by test B.

Once identified, the mutated manL, manM or manN gene according to the invention can be introduced in lieu of the manL, manM or manN of a lactose-positive, galactose-negative, Streptococcus thermophilus strain, defined under I, II, III, IV or V above.

Examples of Some Strains of the Invention

The invention is directed to the Streptococcus thermophilus DSM32587 strain deposited at the DSMZ on Aug. 15, 2017, or any variant thereof. The DSM32587 strain, carrying a glcK gene as defined in SEQ ID NO:21 (encoding a glucokinase as defined in SEQ ID NO:22), was shown to have a glucokinase activity in said strain of 907 U/g total protein extract, a Vmax in said strain of 914 U/g total protein extract, while releasing in fermented milk 29 mM of glucose (as assayed respectively by test A, test C and test B).

A variant of the DSM32587 strain is defined herein as a lactose-positive, galactose-negative Streptococcus thermophilus strain obtained from the DSM32587 strain and bearing the same glcK gene (SEQ ID NO:21) as the DSM32587 strain, and wherein the glucokinase activity in said strain fulfils the "significantly reduced but not null" feature of glucokinase activity as defined herein and fulfils the "significantly reduced but not null" feature of the glucokinase Vmax as defined herein.

In an embodiment, a variant of the DSM32587 strain exhibits a ratio of the beta-galactosidase activity as assayed by test D over the glucokinase activity as assayed by test E, the minimal value of which is selected from the group consisting of which is at least $4 \cdot 10^{-6}$, at least $5 \cdot 10^{-6}$, at least $6 \cdot 10^{-6}$, at least $7 \cdot 10^{-6}$ and at least $8 \cdot 10^{-6}$, and optionally the maximal value of which is less than $8 \cdot 10^{-3}$.

In a particular embodiment, the variant of the DSM32587 strain expresses a GlcK protein as defined in SEQ ID NO:22, the glucokinase activity of which in said variant is between 800 and 1000 U/g total protein extract as assayed by test A and the glucokinase Vmax in said variant is between 800 and 1000 U/g total protein extract as assayed by test C.

In a particular embodiment, the DSM32587 variant of the invention is further characterized by the fact that the concentration of glucose in a milk fermented with said variant as assayed by test B, is at least 20 mM. In a particular embodiment, the DSM32587 variant of the invention is characterized by the fact that the concentration of glucose in a milk fermented with said variant as assayed by test B, is at least the concentration of glucose in a milk fermented with the DSM32587 strain as assayed by test B.

Non-limitative examples of variants are for example CRISPR variants, i.e., variants of the DSM32587 strain having one or more of its CRISPR locus(loci) modified by insertion and/or deletion of one or more spacers (as compared to the CRISPR locus(loci) of the DSM32587 strain).

The invention is also directed to the following lactose-positive, galactose-negative Streptococcus thermophilus strains:

a strain corresponding to the DSM32587 strain into which the coding sequence of the ccpA gene is replaced by the sequence as set forth in SEQ ID NO:71 (ccpA$_{A14114-120}$) and its variants; a variant is defined herein as a lactose-positive, galactose-negative Streptococcus thermophilus strain bearing the same mutated ccpA gene, and exhibiting a ratio of the beta-galactosidase activity as assayed by test D over the glucokinase activity as assayed by test E, the minimal value of which is selected from the group consisting of which is at least $4 \cdot 10^{-6}$, at least $5 \cdot 10^{-6}$, at least $6 \cdot 10^{-6}$, at least $7 \cdot 10^{-6}$ and at least $8 \cdot 10^{-6}$, and optionally the maximal value of which is less than $8 \cdot 10^{-3}$;

a strain corresponding to the DSM32587 strain into which the coding sequence of the manL gene is replaced by the sequence as set forth in SEQ ID NO:155 (encoding IIAB$^{Man}_{305STOP}$) and its variants; a variant is defined herein as a lactose-positive, galactose-negative Streptococcus thermophilus strain bearing the same mutated manL gene, and exhibiting a ratio of the beta-galactosidase activity as assayed by test D over the glucokinase activity as assayed by test E, the minimal value of which is selected from the group consisting of which is at least $4 \cdot 10^{-6}$, at least $5 \cdot 10^{-6}$, at least $6 \cdot 10^{-6}$, at least $7 \cdot 10^{-6}$ and at least $8 \cdot 10^{-6}$, and optionally the maximal value of which is less than $8 \cdot 10^{-3}$;

a strain corresponding to the DSM32587 strain into which the coding sequence of the manM gene is replaced by the sequence as set forth in SEQ ID NO:201 (encoding IIC$^{Man}_{208}$) and its variants; a variant is defined herein as a lactose-positive, galactose-negative Streptococcus thermophilus strain bearing the same mutated manM gene, and exhibiting a ratio of the beta-galactosidase activity as assayed by test D over the glucokinase activity as assayed by test E, the minimal value of which is selected from the group consisting of which is at least $4 \cdot 10^{-6}$, at least $5 \cdot 10^{-6}$, at least $6 \cdot 10^{-6}$, at least $7 \cdot 10^{-6}$ and at least $8 \cdot 10^{-6}$, and optionally the maximal value of which is less than $8 \cdot 10^{-3}$;

a strain corresponding to the DSM32587 strain into which the coding sequence of the manN gene is replaced by the sequence as set forth in SEQ ID NO:250 (encoding IID$^{Man}_{28}$) and its variants; a variant is defined herein as a lactose-positive, galactose-negative Streptococcus thermophilus strain bearing the same mutated manN gene, and exhibiting a ratio of the beta-galactosidase activity as assayed by test D over the glucokinase activity as assayed by test E, the minimal value of which is selected from the group consisting of which is at least $4 \cdot 10^{-6}$, at least $5 \cdot 10^{-6}$, at least $6 \cdot 10^{-6}$, at least $7 \cdot 10^{-6}$ and at least $8 \cdot 10^{-6}$, and optionally the maximal value of which is less than $8 \cdot 10^{-3}$;

a strain corresponding to the DSM32587 strain into which the coding sequence of the ccpA gene is replaced by the sequence as set forth in SEQ ID NO:71 (ccpA$_{A14114-120}$ and the coding sequence of the manL gene is replaced by the sequence as set forth in SEQ ID NO:155 (encoding IIAB$^{Man}_{305STOP}$) and its variants; a variant is defined herein as a lactose-positive, galactose-negative Streptococcus thermophilus strain bearing the same mutated ccpA gene and same mutated manL gene, and exhibiting a ratio of the beta-galactosidase activity as assayed by test D over the glucokinase activity as assayed by test E, the minimal value of which is selected from the group consisting of which is at least $4 \cdot 10^{-6}$, at least $5 \cdot 10^{-6}$, at least $6 \cdot 10^{-6}$, at least $7 \cdot 10^{-6}$ and at least $8 \cdot 10^{-6}$, and optionally the maximal value of which is less than $8 \cdot 10^{-3}$;

a strain corresponding to the DSM32587 strain into which the coding sequence of the ccpA gene is replaced by the sequence as set forth in SEQ ID NO:71 (ccpA$_{A14114-120}$ and the coding sequence of the manM gene is replaced by the sequence as set forth in SEQ ID NO:201 (encoding IIC$^{Man}_{208}$) and its variants; a variant is defined herein as a lactose-positive, galactose-negative *Streptococcus thermophilus* strain bearing the same mutated ccpA gene and same mutated manM gene, and exhibiting a ratio of the beta-galactosidase activity as assayed by test D over the glucokinase activity as assayed by test E, the minimal value of which is selected from the group consisting of which is at least $4\cdot10^{-6}$, at least $5\cdot10^{-6}$, at least $6\cdot10^{-6}$, at least $7\cdot10^{-6}$ and at least $8\cdot10^{-6}$, and optionally the maximal value of which is less than $8\cdot10^{-3}$;

a strain corresponding to the DSM32587 strain into which the coding sequence of the ccpA gene is replaced by the sequence as set forth in SEQ ID NO:71 (ccpA$_{A14114-120}$ and the coding sequence of the manN gene is replaced by the sequence as set forth in SEQ ID NO:250 (encoding IID$^{Man}_{28}$) and its variants; a variant is defined herein as a lactose-positive, galactose-negative *Streptococcus thermophilus* strain bearing the same mutated ccpA gene and same mutated manN gene, and exhibiting a ratio of the beta-galactosidase activity as assayed by test D over the glucokinase activity as assayed by test E, the minimal value of which is selected from the group consisting of which is at least $4\cdot10^{-6}$, at least $5\cdot10^{-6}$, at least $6\cdot10^{-6}$, at least $7\cdot10^{-6}$ and at least $8\cdot10^{-6}$, and optionally the maximal value of which is less than $8\cdot10^{-3}$;

a strain corresponding to the DSM28255 strain into which the coding sequence of the ccpA gene is replaced by the sequence as set forth in SEQ ID NO:71 (ccpA$_{A14114-120}$) and its variants; a variant is defined herein as a lactose-positive, galactose-negative *Streptococcus thermophilus* strain bearing the same mutated ccpA gene and exhibiting a ratio of the beta-galactosidase activity as assayed by test D over the glucokinase activity as assayed by test E, the minimal value of which is selected from the group consisting of which is at least $4\cdot10^{-6}$, at least $5\cdot10^{-6}$, at least $6\cdot10^{-6}$, at least $7\cdot10^{-6}$ and at least $8\cdot10^{-6}$, and optionally the maximal value of which is less than $8\cdot10^{-3}$.

a strain corresponding to the DSM28255 strain into which the coding sequence of the ccpA gene is replaced by the sequence as set forth in SEQ ID NO:71 (ccpA$_{A14114-120}$) and the coding sequence of the manL gene is replaced by the sequence as set forth in SEQ ID NO:155 (encoding IIAB$^{Man}_{305STOP}$) and its variants; a variant is defined herein as a lactose-positive, galactose-negative *Streptococcus thermophilus* strain bearing the same mutated ccpA gene and same mutated manL gene, and exhibiting a ratio of the beta-galactosidase activity as assayed by test D over the glucokinase activity as assayed by test E, the minimal value of which is selected from the group consisting of which is at least $4\cdot10^{-6}$, at least $5\cdot10^{-6}$, at least $6\cdot10^{-6}$, at least $7\cdot10^{-6}$ and at least $8\cdot10^{-6}$, and optionally the maximal value of which is less than $8\cdot10^{-3}$.

a strain corresponding to the DSM28255 strain into which the coding sequence of the ccpA gene is replaced by the sequence as set forth in SEQ ID NO:71 (ccpA$_{A14114-120}$) and the coding sequence of the manM gene is replaced by the sequence as set forth in SEQ ID NO:201 (encoding IIC$^{Man}_{208}$) and its variants; a variant is defined herein as a lactose-positive, galactose-negative *Streptococcus thermophilus* strain bearing the same mutated ccpA gene and same mutated manM gene, and exhibiting a ratio of the beta-galactosidase activity as assayed by test D over the glucokinase activity as assayed by test E, the minimal value of which is selected from the group consisting of which is at least $4\cdot10^{-6}$, at least $5\cdot10^{-6}$, at least $6\cdot10^{-6}$, at least $7\cdot10^{-6}$ and at least $8\cdot10^{-6}$, and optionally the maximal value of which is less than $8\cdot10^{-3}$.

a strain corresponding to the DSM28255 strain into which the coding sequence of the ccpA gene is replaced by the sequence as set forth in SEQ ID NO:71 (ccpA$_{A14114-120}$ and the coding sequence of the manN gene is replaced by the sequence as set forth in SEQ ID NO:250 (encoding IID$^{Man}_{28}$) and its variants; a variant is defined herein as a lactose-positive, galactose-negative *Streptococcus thermophilus* strain bearing the same mutated ccpA gene and same mutated manN gene, and exhibiting a ratio of the beta-galactosidase activity as assayed by test D over the glucokinase activity as assayed by test E, the minimal value of which is selected from the group consisting of which is at least $4\cdot10^{-6}$, at least $5\cdot10^{-6}$, at least $6\cdot10^{-6}$, at least $7\cdot10^{-6}$ and at least $8\cdot10^{-6}$, and optionally the maximal value of which is less than $8\cdot10^{-3}$.

In a particular embodiment, the genome sequence of the strain variant as defined herein has an identity of at least 90%, with the genome sequence of the strain the variant is obtained from, in particular an identity of at least 90%, at least 91%, at least 95%, at least 93%, at least 94%, at least 95%, at least 96%, at least 97%, at least 98%, at least 99%, at least 99.1%, at least 99.2%, at least 99.3%, at least 99.4%, at least 99.5%, at least 99.6%, at least 99.7%, at least 99.8%, at least 99.9%, at least 99.92%, at least 99.94%, at least 99.96%, at least 99.98%, or at least 99.99% with the genome sequence of the strain the variant is obtained from. The identity is described in comparing the two genome sequences over their full-length (global alignment), and may be calculated using any program based on the Needleman-Wunsch algorithm.

In an embodiment, the lactose-positive, galactose-negative *Streptococcus thermophilus* strain of the invention does not carry a glcK gene coding for a glucokinase having a serine at position 144 (i.e., the codon 144 of the glcK gene does not code for a serine), with the exception of a lactose-positive, galactose-negative *Streptococcus thermophilus* strain selected from the group consisting of:

a) a lactose-positive, galactose-negative *Streptococcus thermophilus* strain as defined under III, the glcK gene of which codes for a glucokinase having a serine at position 144; and b) a lactose-positive, galactose-negative *Streptococcus thermophilus* strain as defined under VI, the glcK gene of which codes for a glucokinase having a serine at position 144

In an embodiment, the lactose-positive, galactose-negative *Streptococcus thermophilus* strain of the invention does carry a glcK gene coding for a glucokinase having a serine at position 144, with the exception of a lactose-positive, galactose-negative *Streptococcus thermophilus* strain selected from the group consisting of:

a) a lactose-positive, galactose-negative *Streptococcus thermophilus* strain, the ccpA gene of which is mutated as defined under III and the glcK gene of which codes for a glucokinase having a serine at position 144;

b) a lactose-positive, galactose-negative *Streptococcus thermophilus* strain, the manL gene of which is mutated as defined under VI and the glcK gene of which codes for a glucokinase having a serine at position 144;

c) a lactose-positive, galactose-negative *Streptococcus thermophilus* strain, the manM gene of which is mutated as defined under VI and the glcK gene of which codes for a glucokinase having a serine at position 144; and d) a lactose-positive, galactose-negative *Streptococcus thermophilus* strain, the manN gene of which is mutated as defined under VI and the glcK gene of which codes for a glucokinase having a serine at position 144

In an embodiment, the lactose-positive, galactose-negative *Streptococcus thermophilus* strain of the invention does not carry a glcK gene coding for a glucokinase having a serine at position 144, with the exception of a lactose-positive, galactose-negative *Streptococcus thermophilus* strain selected from the group consisting of:

a) a lactose-positive, galactose-negative *Streptococcus thermophilus* strain, the ccpA gene of which is as defined in SEQ ID NO:71 and the glcK gene of which codes for a glucokinase having a serine at position 144;

b) a lactose-positive, galactose-negative *Streptococcus thermophilus* strain, the manL gene of which codes for a IIAB$^{Man}$ truncated in position 305, such as the one defined in SEQ ID NO:156 and the glcK gene of which codes for a glucokinase having a serine at position 144;

c) a lactose-positive, galactose-negative *Streptococcus thermophilus* strain, the manM gene of which codes for a IIC$^{Man}$ truncated in position 208, such as the one defined in SEQ ID NO:202 and the glcK gene of which codes for a glucokinase having a serine at position 144;

d) a lactose-positive, galactose-negative *Streptococcus thermophilus* strain, the manN gene of which codes for a IID$^{Man}$ truncated in position 28, such as the one defined in SEQ ID NO:251 and the glcK gene of which codes for a glucokinase having a serine at position 144;

In an embodiment, the lactose-positive, galactose-negative *Streptococcus thermophilus* strain of the invention as defined under I above does not carry a glcK gene coding for a glucokinase having a serine at position 144.

In an embodiment, the lactose-positive, galactose-negative *Streptococcus thermophilus* strain of the invention does not carry a glcK gene coding for a glucokinase having a serine at position 144.

Composition, Method and Use with Strains the Lactose-Positive, Galactose-Negative *Streptococcus thermophilus* Strains of the Invention The invention is also directed to a bacterial composition comprising or consisting of at least one, in particular one, lactose-positive, galactose-negative *Streptococcus thermophilus* strain of the invention. In a particular embodiment, the bacterial composition is a pure culture, i.e., comprises or consists of a single bacterium strain. In another embodiment, the bacterial composition is a mixed culture, i.e., comprises or consists of the lactose-positive, galactose-negative *Streptococcus thermophilus* strain(s) of the invention and at least one other bacterium strain. By "at least" (in reference to a strain or bacterium), it is meant 1 or more, and in particular 1, 2, 3, 4 or 5 strains.

Thus, in an embodiment, a bacterial composition of the invention comprises or consists of the lactose-positive, galactose-negative *Streptococcus thermophilus* strain(s) of the invention and at least one lactic acid bacterium of the species selected from the group consisting of a *Lactococcus* species, a *Streptococcus* species, a *Lactobacillus* species including *Lactobacillus acidophilus*, an *Enterococcus* species, a *Pediococcus* species, a *Leuconostoc* species, a *Bifidobacterium* species and an *Oenococcus* species or any combination thereof. *Lactococcus* species include *Lactobacillus acidophilus* and *Lactococcus lactis*, including *Lactococcus lactis* subsp. *lactis*, *Lactococcus lactis* subsp. *cremoris* and *Lactococcus lactis* subsp. *lactis* biovar diacetylactis. *Bifidobacterium* species includes *Bifidobacterium animalis*, in particular *Bifidobacterium animalis* subsp *lactis*. Other lactic acid bacteria species include *Leuconostoc* sp., *Streptococcus thermophilus*, *Lactobacillus delbrueckii* subsp. *bulgaricus*, and *Lactobacillus helveticus*.

In an embodiment, the bacterial composition comprises or consists of the lactose-positive, galactose-negative *Streptococcus thermophilus* strain(s) of the invention, and at least one *Streptococcus thermophilus* strain, different from the *S. thermophilus* strain(s) of the invention and/or at least one strain of the *Lactobacillus* species, and/or any combination thereof. In a particular embodiment, the bacterial composition comprises or consists of the *Streptococcus thermophilus* strain(s) of the invention, one or several strain(s) of the species *Lactobacillus delbrueckii* subsp. *bulgaricus* and/or one or several strain(s) of the species *Lactobacillus helveticus* and/or any combination thereof, and optionally at least one *Streptococcus thermophilus* strain, different from the *S. thermophilus* strain(s) of the invention. In a particular embodiment, the bacterial composition comprises or consists of the *Streptococcus thermophilus* strain(s) of the invention, at least one strain of species *Streptococcus thermophilus*, different from the *S. thermophilus* strain(s) of the invention, and a strain of the species *Lactobacillus delbrueckii* subsp. *bulgaricus*. In another particular embodiment, the bacterial composition comprises or consists of the *Streptococcus thermophilus* strain(s) of the invention, and a strain of the species *Lactobacillus delbrueckii* subsp. *bulgaricus*. In an embodiment, the bacterial composition comprises or consists of the *Streptococcus thermophilus* strain(s) of the invention, a *Lactococcus lactis* subsp. *lactis* and/or a *Lactococcus lactis* subsp. *cremoris*.

In a particular embodiment of any bacterial composition defined herein, either as a pure or mixed culture, the bacterial composition further comprises at least one probiotic strain such as *Bifidobacterium animalis* subsp. *lactis, Lactobacillus acidophilus, Lactobacillus paracasei*, or *Lactobacillus casei*.

In a particular embodiment, the bacterial composition, either as a pure or mixed culture as defined above is under frozen, dried, freeze-dried, liquid or solid format, in the form of pellets or frozen pellets, or in a powder or dried powder. In a particular embodiment, the bacterial composition of the invention is in a frozen format or in the form of pellets or frozen pellets, in particular contained into one or more box or sachet. In another embodiment, the bacterial composition as defined herein is under a powder form, such as a dried or freeze-dried powder, in particular contained into one or more box or sachet.

In a particular embodiment, the bacterial composition of the invention, either as a pure culture or mixed culture as defined above, and whatever the format (frozen, dried, freeze-dried, liquid or solid format, in the form of pellets or frozen pellets, or in a powder or dried powder) comprises the lactose-positive, galactose-negative *Streptococcus thermophilus* strain(s) of the invention in a concentration comprised in the range of $10^5$ to $10^{12}$ cfu (colony forming units) per gram of the bacterial composition. In a particular embodiment, the concentration of the lactose-positive, galactose-negative *Streptococcus thermophilus* strain(s) within the bacterial composition of the invention is in the range of $10^7$ to $10^{12}$ cfu per gram of the bacterial composition, and in particular at least $10^7$, at least $10^8$, at least $10^9$, at least $10^{10}$ or at least $10^{11}$ CFU/g of the bacterial composition. In a particular embodiment, when in the form of frozen or dried concentrate, the concentration of the lactose-positive, galactose-negative *Streptococcus thermophilus* strain(s) as pure culture or as a mixed culture—within the bacterial composition is in the range of $10^8$ to $10^{12}$ cfu/g of frozen concentrate or dried concentrate, and more preferably at least $10^8$, at least $10^9$, at least $10^{10}$, at least $10^{11}$ or at least $10^{12}$ cfu/g of frozen concentrate or dried concentrate.

The invention also concerns a method for manufacturing a fermented product, comprising a) inoculating a substrate with the lactose-positive, galactose-negative *Streptococcus thermophilus* strain(s) of the invention and b) fermenting said inoculated substrate, to obtain a fermented product. In a particular embodiment, the lactose-positive, galactose-negative *Streptococcus thermophilus* strain(s) of the invention is inoculated as a bacterial composition as defined herein, such as a pure culture or a mixed culture. In an embodiment, the substrate into which the *S. thermophilus* strain(s) or bacterial composition of the invention is added to is milk substrate. By "milk substrate", it is meant milk of animal and/or plant origin. In a particular embodiment, the milk substrate is of animal origin, such as cow, goat, sheep, buffalo, zebra, horse, donkey, or camel, and the like. The milk may be in the native state, a reconstituted milk, a skimmed milk, or a milk supplemented with compounds necessary for the growth of the bacteria or for the subsequent processing of fermented milk. Therefore, in a particular embodiment, the invention also provides a method for manufacturing a fermented dairy product, comprising a) inoculating a milk substrate with the lactose-positive, galactose-negative *Streptococcus thermophilus* strain(s) or bacterial composition of the invention and b) fermenting said inoculated milk substrate, to obtain a fermented dairy product.

The invention is also directed to the use of the lactose-positive, galactose-negative, *Streptococcus thermophilus* strain(s) of the invention or a composition of the invention, to manufacture a fermented dairy product.

The invention is also directed to a fermented dairy product, which is obtained using the lactose-positive, galactose-negative *Streptococcus thermophilus* strain(s) of the invention or a bacterial composition of the invention, in particular obtained or obtainable by the method of the invention. Thus, the invention is directed to a fermented dairy product comprising the lactose-positive, galactose-negative *Streptococcus thermophilus* strain(s) of the invention. In a particular embodiment, the fermented dairy food product of the invention is fresh fermented milk. In a particular embodiment, the fermented dairy product of the invention—in particular the fresh fermented milk as defined herein—contains the DSM32587 strain deposited at the DSMZ on Aug. 15, 2017 or any variant thereof as defined herein.

Proteins, Nucleic Acids, Vectors, Constructs and their Uses

The invention also concerns a *Streptococcus thermophilus* glucokinase, the glucokinase activity of which is significantly reduced but not null in a DGCC7710 derivative. To test that a glucokinase of the invention fulfils the "significantly reduced but not null" glucokinase activity feature in a DGCC7710 derivative, the glcK gene of the DGCC7710 strain is replaced by the glcK gene encoding the *Streptococcus thermophilus* glucokinase of the invention to be assayed to obtain the derivative of DGCC7710, and the DGCC7710 derivative is assayed by test A (see example 4).

A *Streptococcus thermophilus* glucokinase fulfils the "significantly reduced but not null" glucokinase activity feature in a DGCC7710 derivative, when a) either the glucokinase activity of said *Streptococcus thermophilus* glucokinase in a DGCC7710 derivative is between 200 and 1500 U/g of total protein extract, as assayed by test A, in particular between 300 and 1200 U/g or between 400 and 1000 U/g of total protein extract, as assayed by test A, or b) the glucokinase activity of said *Streptococcus thermophilus* glucokinase in a DGCC7710 derivative is between 5 and 60% the glucokinase activity of the DGCC7710 strain deposited at the DSMZ under accession number DSM28255 on Jan. 14, 2014, when both assayed by test A, in particular between 10 and 50% or between 15 and 40% the glucokinase activity of the DGCC7710 strain, wherein the glucokinase activity in said DG7710 derivative and the glucokinase activity of the DGCC7710 strain are assayed by test A.

In a particular embodiment, the glucokinase activity of the *Streptococcus thermophilus* glucokinase of the invention in a DGCC7710 derivative is between 200 and 1500 U/g of total protein extract, as assayed by test A. In a particular embodiment, the glucokinase activity of the *Streptococcus thermophilus* glucokinase of the invention in a DGCC7710 derivative is between 300 and 1200 U/g of total protein extract, as assayed by test A. In a particular embodiment, the glucokinase activity of the *Streptococcus thermophilus* glucokinase of the invention in a DGCC7710 derivative is between 400 and 1000 U/g of total protein extract, as assayed by test A. In a particular embodiment, the glucokinase activity of the *Streptococcus thermophilus* glucokinase of the invention in a DGCC7710 derivative is between a minimal value selected from the group consisting of 200, 300 and 400 U/g of total protein extract and a maximal value selected from the group consisting of 1000, 1200 and 1500 U/g of total protein extract, as assayed by test A. It is noteworthy that, as mentioned in test A, the glucokinase activity values disclosed herein are the mean of three experiments (triplicates).

In a particular embodiment, the glucokinase activity of the *Streptococcus thermophilus* glucokinase of the invention in a DGCC7710 derivative is between 5 and 60% the activity of the glucokinase activity of the DGCC7710 strain deposited at the DSMZ under accession number DSM28255 on Jan. 14, 2014. By "glucokinase activity of the DGCC7710 strain" it is meant the activity of the DGCC7710 strain glucokinase (i.e., with SEQ ID NO:2) as assayed by test A in the DGCC7710 strain [i.e., the test A is carried out using the DGCC7710 strain]. The percentage value is calculated based on the glucokinase activity of the *Streptococcus thermophilus* glucokinase of the invention in a DGCC7710 derivative and the glucokinase activity of the DGCC7710 strain, both assayed by test A.

In a particular embodiment, the glucokinase activity of the *Streptococcus thermophilus* glucokinase of the invention in a DGCC7710 derivative is between 5 and 60% the glucokinase activity of the DGCC7710 strain. In a particular embodiment, the glucokinase activity of the *Streptococcus thermophilus* glucokinase of the invention in a DGCC7710 derivative is between 10 and 50% the glucokinase activity of the DGCC7710 strain. In a particular embodiment, the glucokinase activity of the *Streptococcus thermophilus* glucokinase of the invention in a DGCC7710 derivative is between 15 and 40% the glucokinase activity of the strain DGCC7710. In a particular embodiment, the glucokinase activity of the *Streptococcus thermophilus* glucokinase of the invention in a DGCC7710 derivative is between a minimal percentage selected from the group consisting of 5, 10 and 15% the glucokinase activity of the DGCC7710 strain and a maximal percentage selected from the group consisting of 40, 50 and 60% the glucokinase activity of the DGCC7710 strain. In a particular embodiment and whatever the range of percentages, the glucokinase activity of the *Streptococcus thermophilus* glucokinase of the invention is assayed in a DGCC7710 derivative by test A as described herein. It is noteworthy that the percentage values disclosed herein are calculated based on glucokinase activity values which are the mean of three independent experiments (triplicates) as assayed by test A.

The feature "glucokinase activity in a DGCC7710 derivative is significantly reduced but not null" can also be characterized, in a DGCC7710 derivative, by the maximum forward velocity of the glucokinase (Vmax) or by the affinity of the glucokinase (called Km) for one or two of its substrates, i.e., glucose and ATP. In an embodiment, the feature "significantly reduced but not null glucokinase activity in a DGCC7710 derivative" of the *Streptococcus thermophilus* glucokinase of the invention is further characterized by the maximum forward velocity of this glucokinase in a DGCC7710 derivative.

Therefore, in combination with the embodiment of the feature "glucokinase activity in a DGCC7710 derivative is significantly reduced but not null" defined herein, the maximum forward velocity (Vmax) of the *Streptococcus thermophilus* glucokinase of the invention is significantly reduced but not null in a DGCC7710 derivative. To test that a glucokinase of the invention fulfils the "significantly reduced but not null" Vmax feature in a DGCC7710 derivative, the open reading frame of the glcK gene of the DGCC7710 strain is replaced by the open reading frame of the glcK gene encoding the *Streptococcus thermophilus* glucokinase of the invention to be assayed to obtain a derivative of DGCC7710, and the DGCC7710 derivative is assayed by test C (see example 4). The expression "DGCC7710 derivative" is as defined above.

The "significantly reduced but not null in a DGCC7710 derivative" feature of the Vmax of the glucokinase of the invention can be defined by one or two of these parameters:
the Vmax of the *Streptococcus thermophilus* glucokinase of the invention in a DGCC7710 derivative is between 200 and 1500 U/g total protein extract, as assayed by test C;
the Vmax of the *Streptococcus thermophilus* glucokinase of the invention in a DGCC7710 derivative is between 5 and 60% the Vmax of the glucokinase of the DGCC7710 strain deposited at the DSMZ under accession number DSM28255 on Jan. 14, 2014, when both assayed by test C.

In a particular embodiment, the invention relates to a *Streptococcus thermophilus* glucokinase of the invention, the glucokinase activity of which in a DGCC7710 derivative is significantly reduced but not null (as defined herein) and wherein the maximum forward velocity (Vmax) of said glucokinase in a DGCC7710 derivative is significantly reduced but not null, and defined by one or two of these parameters:
the Vmax of the *Streptococcus thermophilus* glucokinase of the invention in a DGCC7710 derivative is between 200 and 1500 U/g total protein extract, as assayed by test C;
the Vmax of the *Streptococcus thermophilus* glucokinase of the invention in a DGCC7710 derivative is between 5 and 60% the Vmax of the glucokinase of the DGCC7710 strain deposited at the DSMZ under accession number DSM28255 on Jan. 14, 2014, when both assayed by test C.

In a particular embodiment, the Vmax of the *Streptococcus thermophilus* glucokinase of the invention in a DGCC7710 derivative is between 200 and 1500 U/g total protein extract, as assayed by test C. In a particular embodiment, the Vmax of the *Streptococcus thermophilus* glucokinase of the invention in in a DGCC7710 derivative is between 300 and 1200 U/g total protein extract, as assayed by test C. In a particular embodiment, the Vmax of the *Streptococcus thermophilus* glucokinase of the invention in a DGCC7710 derivative is between 400 and 1000 U/g total protein extract. In a particular embodiment, the Vmax of the *Streptococcus thermophilus* glucokinase of the invention in a DGCC7710 derivative is between a minimal value selected from the group consisting of 200, 300 and 400 U/g of total protein extract and a maximal value selected from the group consisting of 1000, 1200 and 1500 U/g of total protein extract, as assayed by test C.

In a particular embodiment, the Vmax of the *Streptococcus thermophilus* glucokinase of the invention in a DGCC7710 derivative is between 10 and 50% the Vmax of the glucokinase of the DGCC7710 strain, when both assayed by test C. By "Vmax of the glucokinase of the DGCC7710 strain" it is meant the Vmax of the DGCC7710 strain glucokinase (i.e., with SEQ ID NO:2) as assayed by test C in the DGCC7710 strain [i.e., the test C is carried out using the DGCC7710 strain]. The percentage value is calculated based on the Vmax of the *Streptococcus thermophilus* glucokinase of the invention in a DGCC7710 derivative and the Vmax of the glucokinase of DGCC7710 strain, both assayed by test C. In a particular embodiment, the Vmax of the *Streptococcus thermophilus* glucokinase of the invention in a DGCC7710 derivative is between 15 and 40% the Vmax of the glucokinase of the DGCC7710 strain. In a particular embodiment, the Vmax of the *Streptococcus thermophilus* glucokinase of the invention in a DGCC7710 derivative is between a minimal percentage selected from the group consisting of 5, 10 and 15% the Vmax of the glucokinase activity of the DGCC7710 strain and a maximal percentage selected from the group consisting of 40, 50 and 60% the Vmax of the glucokinase activity of the DGCC7710 strain.

In an embodiment, the sequence of the *Streptococcus thermophilus* glucokinase of the invention having a significantly reduced but not null glucokinase activity in a DGCC7710 derivative and optionally a significantly reduced but not null Vmax in a DGCC7710 derivative has at its position 275 (numbering based on the sequence as defined in SEQ ID NO:25) an amino acid which is not a glutamic acid (i.e., is any amino acid except a glutamic acid). In an embodiment, the sequence of the *Streptococcus thermophilus* glucokinase of the invention having a significantly reduced but not null glucokinase activity in a DGCC7710 derivative and optionally a significantly reduced but not null in a DGCC7710 derivative has at its position 275 (numbering based on the sequence as defined in SEQ ID NO:25) an amino acid which is not an acidic amino acid (i.e., is any amino acid except an acidic amino acid). In an embodiment, the sequence of the *Streptococcus thermophilus* glucokinase of the invention having a significantly reduced but not null glucokinase activity in a DGCC7710 derivative and optionally a significantly reduced but not null Vmax in a DGCC7710 derivative has at its position 275 (numbering based on the sequence as defined in SEQ ID NO:25) an amino acid which is selected from the group consisting of a lysine and any of its conservative amino acids. In an embodiment, the sequence of the *Streptococcus thermophilus* glucokinase of the invention having a significantly reduced but not null glucokinase activity in a DGCC7710 derivative and optionally a significantly reduced but not null in a DGCC7710 derivative has at its position 275 (numbering based on the sequence as defined in SEQ ID NO:25) an amino acid which is a lysine. In a particular embodiment, the *Streptococcus thermophilus* glucokinase of the invention is 322 amino acids in length. In an embodiment, when the *Streptococcus thermophilus* glucokinase has at its position 275 an amino acid which is not a glutamic acid (in particular which is not an acidic amino acid, in particular which is a lysine), the *Streptococcus thermophilus* glucokinase has an arginine at its position 278 and/or a serine at its position 279.

In an embodiment, the sequence of the *Streptococcus thermophilus* glucokinase of the invention having a significantly reduced but not null glucokinase activity in a DGCC7710 derivative and optionally a significantly reduced but not null Vmax in a DGCC7710 derivative has at its position 144 (numbering based on the sequence as defined in SEQ ID NO:46) an amino acid which is not a glycine (i.e., is any amino acid except a glycine). In an embodiment, the sequence of the *Streptococcus thermophilus* glucokinase of the invention having a significantly reduced but not null glucokinase activity in a DGCC7710 derivative and optionally a significantly reduced but not null in a DGCC7710 derivative has at its position 144 (numbering based on the sequence as defined in SEQ ID NO:46) an amino acid which is not an aliphatic amino acid (i.e., is any amino acid except an aliphatic amino acid). In an embodiment, the sequence of the *Streptococcus thermophilus* glucokinase of the invention having a significantly reduced but not null glucokinase activity in a DGCC7710 derivative and optionally a significantly reduced but not null Vmax in a DGCC7710 derivative has at its position 144 (numbering based on the sequence as defined in SEQ ID NO:46) an amino acid which is selected from the group consisting of a serine and any of its conservative amino acids. In an embodiment, the sequence of the *Streptococcus thermophilus* glucokinase of the invention having a significantly reduced but not null glucokinase activity in a DGCC7710 derivative and optionally a significantly reduced but not null in a DGCC7710 derivative has at its position 144 (numbering based on the sequence as defined in SEQ ID NO:46) an amino acid which is a serine. In a particular embodiment, the *Streptococcus thermophilus* glucokinase of the invention is 322 amino acids in length.

In a particular embodiment, the sequence of the *Streptococcus thermophilus* glucokinase of the invention having a significantly reduced but not null glucokinase activity in a DGCC7710 derivative and optionally a significantly reduced but not null in a DGCC7710 derivative is selected from the group consisting of:

a) a sequence as defined in SEQ ID NO:25, wherein the amino acid at position 275 is any amino acid except a glutamic acid, in particular is any amino acid except an acidic amino acid, in particular is a lysine; and b) a GlcK variant sequence having at least 90% similarity or identity with SEQ ID NO:25, wherein the amino acid of the glucokinase corresponding to position 275 of SEQ ID NO:25 (or the amino acid at position 275 of the glucokinase) is any amino acid except a glutamic acid, in particular is any amino acid except an acidic amino acid, in particular is a lysine. In a particular embodiment, the GlcK variant sequence is 322-amino acids in length. In an embodiment, said GlcK variant has an arginine at its position 278 and/or a serine at its position 279.

c) a sequence as defined in SEQ ID NO:46, wherein the amino acid at position 144 is any amino acid except a glycine, in particular is any amino acid except an aliphatic amino acid, in particular is a serine; and d) a GlcK variant sequence having at least 90% similarity or identity with SEQ ID NO:46, wherein the amino acid of the glucokinase corresponding to position 144 of SEQ ID NO:46 (or the amino acid at position 144 of the glucokinase) is any amino acid except a glycine, in particular is any amino acid except an aliphatic amino acid, in particular is a serine. In a particular embodiment, the GlcK variant sequence is 322-amino acids in length.

For the definition of the GlcK variant having at least 90% similarity or identity with SEQ ID NO:25, the similarity or identity is calculated herein over the whole length of the 2 sequences after optimal alignment [i.e., number of similar or identical amino acid residues in the aligned parts(s) of the sequences]; the position 275 as defined in SEQ ID NO:25 is not considered for the calculation of the similarity or identity. In a particular embodiment, the GlcK variant sequence has at least 91, 92, 93, 94, 95, 96, 97, 98 or 99% similarity or identity with SEQ ID NO:25, wherein the amino acid of the glucokinase corresponding to position 275 of SEQ ID NO:25 (or the amino acid at position 275 of the glucokinase) is any amino acid except a glutamic acid, in particular is any amino acid except an acidic amino acid, in particular is a lysine. In an embodiment, the GlcK variant sequence has at least 95% similarity or identity with SEQ ID NO:25, wherein the amino acid corresponding to position 275 of SEQ ID NO:25 (or the amino acid at position 275 of the glucokinase) is any amino acid except a glutamic acid, in particular is any amino acid except an acidic amino acid, in particular is a lysine. In an embodiment, the GlcK variant sequence has at least 97% similarity or identity with SEQ ID NO:25, wherein the amino acid corresponding to position 275 of SEQ ID NO:25 (or the amino acid at position 275 of the glucokinase) is any amino acid except a glutamic acid, in particular is any amino acid except an acidic amino acid, in particular is a lysine.

In a particular embodiment, the GlcK variant sequence differs from SEQ ID NO:25 by from 1 to 30 amino acid substitutions wherein the amino acid at position 275 of said GlcK variant is any amino acid except a glutamic acid, in particular is any amino acid except an acidic amino acid, in particular is a lysine (the position 275 is not considered for the calculation of the number of substitution(s)). In a particular embodiment, the GlcK variant sequence differs from SEQ ID NO:25 by from 1 to 20 amino acid substitutions, wherein the amino acid at position 275 of said GlcK variant is any amino acid except a glutamic acid, in particular is any amino acid except an acidic amino acid, in particular is a lysine. In a particular embodiment, the GlcK variant sequence differs from SEQ ID NO:25 by from 1 to 15 amino acid substitutions wherein the amino acid at position 275 of said GlcK variant is any amino acid except a glutamic acid, in particular is any amino acid except an acidic amino acid, in particular is a lysine. In a particular embodiment, the GlcK sequence differs from SEQ ID NO:25 by from 1 to 10 amino acid substitutions wherein the amino acid at position 275 of said GlcK variant is any amino acid except a glutamic acid, in particular is any amino acid except an acidic amino acid, in particular is a lysine. In a particular embodiment, the GlcK sequence differs from SEQ ID NO:25 by 1, 2, 3, 4, 5, 6, 7, 8, 9, 10, 11 or 12 amino acid substitutions wherein the amino acid at position 275 of said GlcK variant is any amino acid except a glutamic acid, in particular is any amino acid except an acidic amino acid, in particular is a lysine.

In a particular embodiment, the sequence of the *Streptococcus thermophilus* glucokinase of the invention is selected from the group consisting of SEQ ID NOs: 25, 26, 27, 28, 29, 30, 31, 32, 33 and 34, wherein the amino acid at position 275 of said variant is any amino acid except a glutamic acid, in particular is any amino acid except an acidic amino acid, in particular is a lysine. In a particular embodiment, either as the SEQ ID NO:25 or any GlcK variant sequence having at least 90% similarity or identity with SEQ ID NO:25 as defined herein (in particular SEQ ID NO: 26, 27, 28, 29, 30, 31, 32, 33 or 34), the amino acid of the glucokinase of the invention corresponding to position 275 of SEQ ID NO:25 (or the amino acid at position 275 of the glucokinase of the invention) is not a glutamic acid.

In a particular embodiment, either as the SEQ ID NO:25 or any GlcK variant sequence having at least 90% similarity or identity with SEQ ID NO:25 as defined herein (in particular SEQ ID NO: 26, 27, 28, 29, 30, 31, 32, 33 or 34), the amino acid of the glucokinase of the invention corresponding to position 275 of SEQ ID NO:25 (or the amino acid at position 275 of the glucokinase of the invention) is not an acidic amino acid. In a particular embodiment, either as the SEQ ID NO:25 or any GlcK variant sequence having at least 90% similarity or identity with SEQ ID NO:25 as defined herein (in particular SEQ ID NO: 26, 27, 28, 29, 30, 31, 32, 33 or 34), the amino acid of the glucokinase of the invention corresponding to position 275 of SEQ ID NO:25 (or the amino acid at position 275 of the glucokinase of the invention) is selected from the group consisting of a lysine and any of its conservative amino acids. In a particular embodiment, either as the SEQ ID NO:25 or any GlcK variant sequence having at least 90% similarity or identity with SEQ ID NO:25 as defined herein (in particular SEQ ID NO: 26, 27, 28, 29, 30, 31, 32, 33 or 34), the amino acid of the glucokinase of the invention corresponding to position 275 of SEQ ID NO:25 (or the amino acid at position 275 of the glucokinase of the invention) is a lysine; thus, in a particular embodiment, the sequence of the *Streptococcus thermophilus* glucokinase of the invention is selected from the group consisting of SEQ ID NOs: 22, 35, 36, 37, 38, 39, 40, 41, 42 and 43.

For the definition of the GlcK variant having at least 90% similarity or identity with SEQ ID NO:46, the similarity or identity is calculated herein over the whole length of the 2 sequences after optimal alignment [i.e., number of similar or identical amino acid residues in the aligned parts(s) of the sequences]; the position 144 as defined in SEQ ID NO:46 is not considered for the calculation of the similarity or identity. In a particular embodiment, the GlcK variant sequence has at least 91, 92, 93, 94, 95, 96, 97, 98 or 99% similarity or identity with SEQ ID NO:46, wherein the amino acid of the glucokinase corresponding to position 144 of SEQ ID NO:46 (or the amino acid at position 144 of the glucokinase) is any amino acid except a glycine, in particular is any amino acid except an aliphatic amino acid, in particular is a serine. In an embodiment, the GlcK variant sequence has at least 95% similarity or identity with SEQ ID NO:46, wherein the amino acid corresponding to position 144 of SEQ ID NO:46 (or the amino acid at position 144 of the glucokinase) is any amino acid except a glycine, in particular is any amino acid except an aliphatic amino acid, in particular is a serine. In an embodiment, the GlcK variant sequence has at least 97% similarity or identity with SEQ ID NO:46, wherein the amino acid corresponding to position 144 of SEQ ID NO:46 (or the amino acid at position 144 of the glucokinase) is any amino acid except a glycine, in particular is any amino acid except an aliphatic amino acid, in particular is a serine.

In a particular embodiment, the GlcK variant sequence differs from SEQ ID NO:46 by from 1 to 30 amino acid substitutions wherein the amino acid at position 144 of said GlcK variant is any amino acid except a glycine, in particular is any amino acid except an aliphatic amino acid, in particular is a serine (the position 144 is not considered for the calculation of the number of substitution(s)). In a particular embodiment, the GlcK variant sequence differs from SEQ ID NO:46 by from 1 to 20 amino acid substitutions, wherein the amino acid at position 144 of said GlcK variant is any amino acid except a glycine, in particular is any amino acid except an aliphatic amino acid, in particular is a serine. In a particular embodiment, the GlcK variant sequence differs from SEQ ID NO:46 by from 1 to 15 amino acid substitutions wherein the amino acid at position 144 of said GlcK variant is any amino acid except a glycine, in particular is any amino acid except an aliphatic amino acid, in particular is a serine. In a particular embodiment, the GlcK sequence differs from SEQ ID NO:46 by from 1 to 10 amino acid substitutions wherein the amino acid at position 144 of said GlcK variant is any amino acid except a glycine, in particular is any amino acid except an aliphatic amino acid, in particular is a serine. In a particular embodiment, the GlcK sequence differs from SEQ ID NO:46 by 1, 2, 3, 4, 5, 6, 7, 8, 9, 10, 11 or 12 amino acid substitutions wherein the amino acid at position 144 5 of said GlcK variant is any amino acid except a glycine, in particular is any amino acid except an aliphatic amino acid, in particular is a serine.

In a particular embodiment, the sequence of the *Streptococcus thermophilus* glucokinase of the invention is selected from the group consisting of SEQ ID NOs: 46, 47, 48, 49, 50, 51, 52, 53, 54 and 55, wherein the amino acid at position 144 of said variant is any amino acid except a glycine, in particular is any amino acid except an aliphatic amino acid, in particular is a serine. In a particular embodiment, either as the SEQ ID NO:46 or any GlcK variant sequence having at least 90% similarity or identity with SEQ ID NO:46 as defined herein (in particular SEQ ID NO: 47, 48, 49, 50, 51, 52, 53, 54 or 55), the amino acid of the glucokinase of the invention corresponding to position 144 of SEQ ID NO:46 (or the amino acid at position 144 of the glucokinase of the invention) is not a glycine.

In a particular embodiment, either as the SEQ ID NO:46 or any GlcK variant sequence having at least 90% similarity or identity with SEQ ID NO:46 as defined herein (in particular SEQ ID NO: 47, 48, 49, 50, 51, 52, 53, 54 or 55), the amino acid of the glucokinase of the invention corresponding to position 144 of SEQ ID NO:46 (or the amino acid at position 144 of the glucokinase of the invention) is not an aliphatic amino acid. In a particular embodiment, either as the SEQ ID NO:46 or any GlcK variant sequence having at least 90% similarity or identity with SEQ ID NO:46 as defined herein (in particular SEQ ID NO: 47, 48, 49, 50, 51, 52, 53, 54 or 55), the amino acid of the glucokinase of the invention corresponding to position 144 of SEQ ID NO:46 (or the amino acid at position 144 of the glucokinase of the invention) is selected from the group consisting of a serine and any of its conservative amino acids. In a particular embodiment, either as the SEQ ID NO:46 or any GlcK variant sequence having at least 90% similarity or identity with SEQ ID NO:46 as defined herein (in particular SEQ ID NO: 47, 48, 49, 50, 51, 52, 53, 54 or 55), the amino acid of the glucokinase of the invention corresponding to position 144 of SEQ ID NO:46 (or the amino acid at position 144 of the glucokinase of the invention) is a serine; thus, in a particular embodiment, the sequence of the *Streptococcus thermophilus* glucokinase of the invention is selected from the group consisting of SEQ ID NOs: 45, 56, 57, 58, 59, 60, 61, 62, 63 and 64.

When defining the sequence of the *Streptococcus thermophilus* glucokinase of the invention, it is according to the teaching of this application that the glucokinase activity in a DGCC7710 derivative expressing this glucokinase is significantly reduced but not null as defined herein and optionally that the Vmax of this glucokinase in a DGCC7710 derivative is significantly reduced but not null as defined herein.

The invention is also directed to a polynucleotide encoding a glucokinase of the invention, in particular a 322-amino acid glucokinase of the invention. In a particular embodiment, said polynucleotide is from a *Streptococcus thermophilus* strain. Based on the genetic code, the person skilled in the art knows whether a polynucleotide encodes a *Streptococcus thermophilus* glucokinase of the invention. In a particular embodiment, when the encoded glucokinase is 322 amino acids in length, the polynucleotide of the invention is 969 nucleotides in length.

A non-limitative example of a polynucleotide of the invention is disclosed in SEQ ID NO:21. Another non-limitative example of a polynucleotide of the invention is disclosed in SEQ ID NO:44. Other non-limitative examples of polynucleotides of the invention are the sequences as defined in SEQ ID Nos: 1, 3, 5, 7, 9, 11, 13, 15, 17 and 19, but into which the codon 144 or 275 encodes any amino acid except a glycine or glutamic acid respectively, in particular encodes any amino acid except an aliphatic or acidic amino acid respectively, in particular encodes a serine or lysine respectively. In particular, non-limitative examples of polynucleotides of the invention are the sequences as defined in SEQ ID Nos: 1, 3, 5, 7, 9, 11, 13, 15, 17 and 19, but into which the codon 275 is AAA or AAG. In particular, non-limitative examples of polynucleotides of the invention are the sequences as defined in SEQ ID Nos: 1, 3, 5, 7, 9, 11, 13, 15, 17 and 19, but into which the codon 144 is AGT, AGC, TCT, TCC, TCA or TCG.

The invention also concerns the use a polynucleotide of the invention (or a construct, plasmid or vector) to design a bacterial cell, in particular a gram-positive bacterial cell, in particular a *Streptococcus thermophilus* cell. In a particular embodiment, the polynucleotide of the invention (or a construct, plasmid or vector) is used to replace the glcK gene of a *Streptococcus thermophilus* strain, such that the *Streptococcus thermophilus* strain expresses a glucokinase of the invention. In a particular embodiment, the only glucokinase expressed by said obtained *Streptococcus thermophilus* is a glucokinase of the invention. In a particular embodiment, the polynucleotide of the invention (or a construct, plasmid or vector) is used to replace the glcK gene of a lactose-positive *Streptococcus thermophilus* strain. In an embodiment, the polynucleotide of the invention (or a construct, plasmid or vector) is used to replace the glcK gene of a lactose-positive, galactose-negative *Streptococcus thermophilus* strain.

The invention is also directed to a mutated ccpA gene (or mutated ccpA polynucleotide) as defined or as identified above.

In an embodiment, the invention is directed to a (mutated) *Streptococcus thermophilus* ccpA polynucleotide, which when inserted in lieu of the ccpA gene of the DGCC7710 strain [giving a DGCC7710 derivative], leads to a DGCC7710 derivative exhibiting a ratio of beta-galactosidase activity as assayed by test D over the glucokinase activity as assayed by test E of at least $4 \cdot 10^{-6}$. In this context, the DGCC7710 derivative is the strain DGCC7710 into which the original ccpA gene has been replaced by the mutated ccpA gene to be assayed.

In an embodiment, the invention is directed to a (mutated) *Streptococcus thermophilus* ccpA, which when inserted in lieu of the ccpA gene of the DSM32587 strain [giving a DSM32587 derivative], leads to a DSM32587 derivative:
  exhibiting a ratio of beta-galactosidase activity as assayed by test D over the glucokinase activity as assayed by test E of at least $4 \cdot 10^{-6}$; and
  releasing a concentration of glucose assayed by test B, which is at least 50 mM or releasing a concentration of glucose which is increased of at least 150% or at least 200% as compared to the glucose concentration released by the DSM32587 strain, when both assayed by test B.

In this context, the DSM32587 derivative is the strain DSM32587 into which the original ccpA gene has been replaced by the mutated ccpA gene to be assayed.

In an embodiment, the mutated ccpA polynucleotide is not a knock-out allele (i.e., a disrupted allele) of the ccpA gene.

In an embodiment, the mutated ccpA polynucleotide is an allele of the ccpA gene mutated in the coding sequence. In an embodiment, the coding sequence of the mutated ccpA polynucleotide differs, by at least one mutation, in particular one mutation, from the ccpA gene as defined in SEQ ID NO:65, 66, 67, 68, 69 or 70.

In an embodiment, the ccpA gene carries a mutation selected from the group consisting of a non-sense mutation located between the nucleotide 1 and the nucleotide 270 of the coding sequence of the ccpA gene and a mutation, located in the first quarter of the coding sequence of the ccpA gene (i.e., between nucleotide 1 and the nucleotide 250), leading to a frameshift of the open reading frame of the ccpA gene. In an embodiment, the mutation leading to a frameshift of the open reading frame of the ccpA gene is located between nucleotide 50 and the nucleotide 200 of the coding sequence of the ccpA gene. In an embodiment, the mutation leading to a frameshift of the open reading frame of the ccpA gene is located between nucleotide 100 and the nucleotide 150 of the coding sequence of the ccpA gene. Whatever the location of the mutation leading to a frameshift, the mutation is selected from the group consisting of a deletion, an insertion or a deletion/insertion (which all are not a multiple of 3). In an embodiment, the mutation of the ccpA gene is a deletion of a nucleotide A in the stretch of 7 nucleotides A at positions 114-120.

In an embodiment, the sequence of the mutated ccpA polynucleotide is selected from the group consisting of a) a sequence as defined in SEQ ID NO:71; and b) a ccpA variant sequence having at least 90% identity with SEQ ID NO:71 (in particular SEQ ID NO: 72 to 76). The definition of the ccpA variant having at least 90% identity is as detailed above under II.

The invention is also directed to the use of a glcK polynucleotide as defined herein [encoding a mutated *Streptococcus thermophilus* glucokinase as defined herein] and/or the use of a ccpA polynucleotide as defined herein to design a *Streptococcus thermophilus* strain. The glcK polynucleotide and ccpA polynucleotide as defined herein are considered mutated according to the invention (i.e., a mutated allele as defined herein or as identifiable by the method described herein). In an embodiment, the glcK polynucleotide as defined herein is used. In an embodiment, the ccpA polynucleotide as defined herein is used. In an embodiment, both the glcK polynucleotide as defined herein and the ccpA polynucleotide as defined herein are used.

In an embodiment, the use consists in substituting [or replacing] the glcK gene and/or the ccpA gene of an original

*Streptococcus thermophilus* strain by a mutated glcK polynucleotide and/or a mutated ccpA polynucleotide as defined herein, to design a *Streptococcus thermophilus* strain having its original gene(s) replaced by the (mutated) one(s) as defined herein. The invention is also directed to a method to design a *Streptococcus thermophilus* strain, comprising 1) substituting [or replacing] the glcK gene and/or the ccpA gene of an original *Streptococcus thermophilus* strain by a mutated glcK polynucleotide and/or a mutated ccpA polynucleotide as defined herein, and 2) obtaining a *Streptococcus thermophilus* strain having its original gene(s) replaced by the (mutated) one(s) as defined herein. In an embodiment of the use or the method, the original *Streptococcus thermophilus* strain is a lactose-positive, galactose-negative, *Streptococcus thermophilus* strain. In an embodiment of the use or the method, the original *Streptococcus thermophilus* strain is a lactose-positive, galactose-negative, *Streptococcus thermophilus* strain exhibiting a ratio of beta-galactosidase activity as assayed by test D over the glucokinase activity as assayed by test E of which is less than $4 \cdot 10^{-6}$ or less than $3 \cdot 10^{-6}$. In an embodiment of the use or the method, the original *Streptococcus thermophilus* strain is a lactose-positive, galactose-negative, *Streptococcus thermophilus* strain, carrying a mutated glcK gene as defined herein or a mutated ccpA gene as defined herein, and exhibiting a ratio of beta-galactosidase activity as assayed by test D over the glucokinase activity as assayed by test E of which is more than $4 \cdot 10^{-6}$.

The invention is also directed to the use of a mutated gene encoding a protein of the mannose-glucose-specific PTS, in particular a mutated manL gene, a mutated manM gene, a mutated manN gene or a mutated manO to design a strain. In an embodiment, the invention is directed to the use of a mutated gene encoding a protein of the mannose-glucose-specific PTS, in particular a mutated manL gene, a mutated manM gene or a mutated manN gene to design a strain. The manL gene, manM gene or manN gene as defined herein are considered mutated according to the invention (i.e., a mutated allele as defined herein or as identifiable by the methods described herein). In an embodiment, the use consists in substituting [or replacing] the manL gene, manM gene or manN gene of an original *Streptococcus thermophilus* strain respectively by a mutated manL, manM or manN polynucleotide as defined herein, to design a *Streptococcus thermophilus* strain having its original gene replaced by the (mutated) one as defined herein. The invention is also directed to a method to design a *Streptococcus thermophilus* strain, comprising 1) substituting [or replacing] the manL gene, manM gene or manN gene of an original *Streptococcus thermophilus* strain respectively by a mutated manL, manM or manN polynucleotide as defined herein, and 2) obtaining a *Streptococcus thermophilus* strain having its original gene replaced by the (mutated) one as defined herein. In an embodiment of the use or the method, the original *Streptococcus thermophilus* strain is a lactose-positive, galactose-negative, *Streptococcus thermophilus* strain. By "respectively", it is meant that the original manL is replaced by the mutated manL, the original manM is replaced by the mutated manM and/or the original manN is replaced by the mutated manN.

In an embodiment of the use or the method, the original *Streptococcus thermophilus* strain is a lactose-positive, galactose-negative, *Streptococcus thermophilus* strain exhibits a ratio of beta-galactosidase activity as assayed by test D over the glucokinase activity as assayed by test E of which is at least $4 \cdot 10^{-6}$ as defined herein. In an embodiment, the original *Streptococcus thermophilus* strain is a lactose-positive, galactose-negative, *Streptococcus thermophilus* strain as defined under any of points I to V above. The inventors have shown that the introduction of a mutated gene encoding a protein of the mannose-glucose-specific PTS, in particular a mutated manL gene, a mutated manM gene or a mutated manN gene, into a *Streptococcus thermophilus* the ratio [of the beta-galactosidase activity in said strain as assayed by test D over the glucokinase activity in said strain as assayed by test E] of which is at least $4 \cdot 10^{-6}$ as defined herein, leads to a synergy with regards to the release of glucose.

In an embodiment, the invention is directed to the use of a mutated *Streptococcus thermophilus* manL gene, manM gene or manN gene encoding respectively a IIAB$^{Man}$ protein, a IIC$^{Man}$ protein or IID$^{Man}$ protein, wherein the glucose import activity of said protein is decreased or abolished, to replace the corresponding manL gene, manM gene or manN gene of a lactose-positive, galactose-negative, *Streptococcus thermophilus* strain exhibiting a ratio of beta-galactosidase activity as assayed by test D over the glucokinase activity as assayed by test E of at least $4 \cdot 10^{-6}$ as defined herein.

In an embodiment, the mutated *Streptococcus thermophilus* manL gene, manM gene or manN gene is characterized by the fact that, when individually inserted in lieu of the manL gene, manM gene or manN gene of the DSM32587 strain [giving a DSM32587 derivative], the DSM32587 derivative:
  exhibits a ratio of beta-galactosidase activity as assayed by test D over the glucokinase activity as assayed by test E of at least $4 \cdot 10^{-6}$; and
  releases a concentration of glucose which is increased of at least 150% or at least 200% as compared to the glucose concentration released by the DSM32587 strain, when both assayed by test B.

In this context, DSM32587 derivative is the strain DSM32587 into which the original manL gene, manM gene or manN gene has been replaced by the mutated manL gene, manM gene or manN gene to be assayed.

In an embodiment, the mutated *Streptococcus thermophilus* manL gene, manM gene or manN gene is characterized by the fact that, when individually inserted in lieu of the manL gene, manM gene or manN gene of the DGCC7710-ccpA$_{A1A114-120}$ strain (i.e., a DGCC7710 strain into which its ccpA gene has previously been replaced by the ccpA gene as defined in SEQ ID NO:71) [giving a DGCC7710-ccpA$_{A1A114-120}$ derivative], the DGCC7710-ccpA$_{A1A114-120}$ derivative:
  exhibits a ratio of beta-galactosidase activity as assayed by test D over the glucokinase activity as assayed by test E of at least $4 \cdot 10^{-6}$; and
  releases a concentration of glucose which is increased of at least 150% or at least 200% as compared to the glucose concentration released by the DGCC7710-ccpA$_{A1A114-120}$ strain, when both assayed by test B.

In this context, DGCC7710-ccpA$_{A1A114-120}$ strain is the DGCC7710 strain into which its ccpA gene has previously been replaced by the ccpA gene as defined in SEQ ID NO:71. In this context, the DGCC7710-ccpA$_{A1A114-120}$ derivative is a DGCC7710-ccpA$_{A1A114-120}$ derivative into which the original manL gene, manM gene or manN gene has been replaced by the mutated manL gene, manM gene or manN gene to be assayed, i.e., a DGCC7710 strain into which the original ccpA gene has been replaced by the ccpA gene as defined in SEQ ID NO:71, and the original manL gene, manM gene or manN gene has been replaced by the mutated manL gene, manM gene or manN gene to be assayed.

By "individually inserted", it is meant that, for characterization of the mutated man gene, only one man gene of the DSM32587 strain or of the DGCC7710-ccpA$_{A14114\text{-}120}$ strain is replaced (or substituted) by the respective mutated man gene to be characterized.

In an embodiment, the mutated gene encoding a protein of the mannose-glucose-specific PTS is a mutated manL gene. In an embodiment, the mutated *Streptococcus thermophilus* manL codes for a *Streptococcus thermophilus* IIAB$^{Man}$ protein, the glucose import activity of which is decreased or abolished, in particular a *Streptococcus thermophilus* IIAB$^{Man}$ protein truncated in position 305 (IIAB$^{Man}_{305}$). In an embodiment, the mutated *Streptococcus thermophilus* manL codes for a truncated *Streptococcus thermophilus* IIAB$^{Man}$ protein, the sequence of which is selected from the group consisting of a) a sequence as defined in SEQ ID NO:156 and b) a IIAB variant sequence having at least 90% similarity or identity with SEQ ID NO:156, in particular being 305 amino acids in length. In an embodiment, the mutated manL gene encodes a IIAB$^{Man}$ protein, the sequence of which is selected from the group consisting of SEQ ID NO:156 to 172. In an embodiment, the mutated *Streptococcus thermophilus* manL gene is as defined in SEQ ID NO:155.

In an embodiment, the mutated gene encoding a protein of the mannose-glucose-specific PTS is a mutated manM gene. In an embodiment, the mutated *Streptococcus thermophilus* manM codes for a *Streptococcus thermophilus* IIC$^{Man}$ protein, the glucose import activity of which is decreased or abolished, in particular a *Streptococcus thermophilus* IIC$^{Man}$ protein truncated in position 208 (IIC$^{Man}_{208}$). In an embodiment, the mutated *Streptococcus thermophilus* manM codes for a truncated *Streptococcus thermophilus* IIC$^{Man}$ protein, the sequence of which is selected from the group consisting of a) a sequence as defined in SEQ ID NO:202 and b) a IIC$^{Man}$ variant sequence having at least 90% similarity or identity with SEQ ID NO:202, in particular being 208 amino acids in length. In an embodiment, the mutated manM gene encodes a IIC$^{Man}$ protein, the sequence of which is selected from the group consisting of SEQ ID NO:202 to 209. In an embodiment, the mutated *Streptococcus thermophilus* manM gene is as defined in SEQ ID NO:201.

In an embodiment, the mutated gene encoding a protein of the mannose-glucose-specific PTS is a mutated manN gene. In an embodiment, the mutated *Streptococcus thermophilus* manN codes for a *Streptococcus thermophilus* IID$^{Man}$ protein, the glucose import activity of which is decreased or abolished, in particular a *Streptococcus thermophilus* IID$^{Man}$ protein truncated in position 28 (IID$^{Man}_{28}$). In an embodiment, the mutated *Streptococcus thermophilus* manN codes for a truncated *Streptococcus thermophilus* IID$^{Man}$ protein, the sequence of which is selected from the group consisting of a) a sequence as defined in SEQ ID NO:251; and b) a IID$^{Man}$ variant sequence having at least 90% similarity or identity with SEQ ID NO:251, in particular being 28 amino acids in length. In an embodiment, the mutated manN gene encodes a IID$^{Man}$ protein, the sequence of which is selected from the group consisting of SEQ ID NO:251 to 255. In an embodiment, the mutated *Streptococcus thermophilus* manN gene is as defined in SEQ ID NO:250.

The expression "IIAB$^{Man}$ variant, IIC$^{Man}$ variant and IID$^{Man}$ variant having at least 90% similarity or identity" is as defined in part VI above.

In an embodiment, the polynucleotide as defined herein is provided under an isolated form. An "isolated" polynucleotide, is substantially or essentially free from components that normally accompany or interact with the gene as found in its naturally occurring environment. Thus, an isolated polynucleotide is substantially free of other cellular material, or culture medium when produced by recombinant techniques, or substantially free of chemical precursors or other chemicals when chemically synthesized.

The invention is also directed to a construct comprising a polynucleotide as defined herein. In an embodiment, the present invention covers a construct comprising a polynucleotide of the invention operably linked to a regulatory sequence. The term "operably linked" refers to a juxtaposition wherein the components described are in a relationship permitting them to function in their intended manner. A regulatory sequence "operably linked" to a coding sequence is ligated in such a way that expression of the coding sequence is achieved under condition compatible with the control sequences. The term "regulatory sequences" includes promoters and/or enhancers and other expression regulation signals. The term "promoter" is used in the normal sense of the art, e.g. an RNA polymerase binding site. In an embodiment, independently or in combination with the "regulatory sequence" embodiment, the construct contains or expresses another gene, such as a marker allowing for the selection of the construct. Various markers exist which may be used, for example those markers that provide for antibiotic resistance—e.g. resistance to bacterial antibiotics—such as Erythromycin, Ampicillin, Streptomycin and Tetracycline.

Thus, in a further aspect, there is provided a vector comprising a polynucleotide or a construct as defined herein. As used herein, the term "vector" refers to any nucleic acid molecule into which another nucleic acid (e.g., the polynucleotide of the invention) can be inserted and which can be introduced into and replicate within bacterial strain such as *Streptococcus thermophilus* strain. Thus, the term refers to any nucleic acid construct (and, if necessary, any associated delivery system) capable of use for introducing genetic material into a bacterial strain, in particular a *Streptococcus thermophilus* strain. Selection of appropriate vectors is within the knowledge of those having skill in the art. In an embodiment, the vector is a plasmid. As used herein, the term "plasmid" refers to a circular double-stranded (ds) DNA construct that can be used as a vector for introducing DNA into a bacterial strain, in particular a *Streptococcus thermophilus* strain. The constructs or the vectors may be introduced into a bacterial strain as described herein, such as the DGCC7710 strain.

The polynucleotide, construct, vector or plasmid of the invention disclosed herein can be introduced into a *Streptococcus thermophilus* strain, using any method available.

"Introducing" (and "introduced") is intended to mean presenting to the *Streptococcus thermophilus* strain, the polynucleotide, construct, vector or plasmid of the invention as defined herein, in such a manner that the component(s) gains access to the interior of the *Streptococcus thermophilus* strain. The methods and compositions do not depend on a particular method for introducing a sequence into a *Streptococcus thermophilus* strain, only that the polynucleotide, construct, vector or plasmid of the invention gains access to the interior of the *Streptococcus thermophilus* strain. Introducing includes the incorporation of a polynucleotide, construct, vector or plasmid of the invention into the *Streptococcus thermophilus* strain where polynucleotide or construct of the invention may be incorporated into the genome of the *Streptococcus thermophilus* strain, and includes the transient (direct) provision of a polynucleotide or construct to the *Streptococcus thermophilus* strain.

Introducing a polynucleotide, construct, vector or plasmid of the invention into a *Streptococcus thermophilus* strain can be carried out by several methods, including transformation, conjugation, transduction or protoplast fusion. Methods for introducing polynucleotide, construct, vector or plasmid of the invention by transformation into a *Streptococcus thermophilus* strain, include, but are not limited to, microinjection, electroporation, stable transformation methods, transient transformation methods [such as induced competence using chemical (e.g. divalent cations such as $CaCl_2$) or mechanical (electroporation) means], ballistic particle acceleration (particle bombardment), direct gene transfer, viral-mediated introduction, cell-penetrating peptides or mesoporous silica nanoparticle (MSN)-mediated direct protein delivery. Introducing a polynucleotide, construct, vector or plasmid of the invention into a *Streptococcus thermophilus* strain can be carried out by conjugation, which is a specific method of natural DNA exchange requiring physical cell-to-cell contact. Introducing a polynucleotide, construct, vector or plasmid of the invention into a *Streptococcus thermophilus* strain can be carried out by transduction, which is the introduction of DNA via a virus (e.g. phage) infection which is also a natural method of DNA exchange. Generally, such methods involve incorporating a polynucleotide within a viral DNA or RNA molecule.

The invention is also directed to the following mutated man genes as such and their corresponding encoded proteins:

the mutated *Streptococcus thermophilus* manL coding for a *Streptococcus thermophilus* truncated $IIAB^{Man}$ protein, the sequence of which is selected from the group consisting of a) a sequence as defined in SEQ ID NO:156 and b) a IIAB variant sequence having at least 90% similarity or identity with SEQ ID NO:156, in particular being 305 amino acids in length. In an embodiment, the mutated *Streptococcus thermophilus* manL gene encodes a $IIAB^{Man}$ protein, the sequence of which is selected from the group consisting of SEQ ID NO:156 to 172. In an embodiment, the mutated *Streptococcus thermophilus* manL gene is as defined in SEQ ID NO:155.

the mutated *Streptococcus thermophilus* manN coding for a *Streptococcus thermophilus* truncated $IID^{Man}$ protein, the sequence of which is selected from the group consisting of a) a sequence as defined in SEQ ID NO:251; and b) a $IID^{Man}$ variant sequence having at least 90% similarity or identity with SEQ ID NO:251, in particular being 28 amino acids in length. In an embodiment, the mutated *Streptococcus thermophilus* manN gene encodes a $IID^{Man}$ protein, the sequence of which is selected from the group consisting of SEQ ID NO:251 to 255. In an embodiment, the mutated *Streptococcus thermophilus* manN gene is as defined in SEQ ID NO:250.

The expression "$IIAB^{Man}$ variant and $IID^{Man}$ variant having at least 90% similarity or identity" is a defined in part VI above.

The invention is also directed to a method to design a lactose-positive, galactose-negative, *Streptococcus thermophilus* strain secreting glucose, comprising:
a) providing a lactose-positive, galactose-negative, *Streptococcus thermophilus* strain, which secrete a glucose concentration less than 1 mM when assayed by test B;
b) mutating one or more gene(s) selected from the group consisting of the glcK gene, the ccpA gene, the lacZ gene and the ptsH gene, and optionally mutating a gene encoding a protein of the mannose-glucose-specific PTS; and
c) selecting from the mutants obtained in b) a lactose-positive, galactose-negative, *Streptococcus thermophilus* strain, wherein the ratio of the beta-galactosidase activity in said strain as assayed by test D over the glucokinase activity in said strain as assayed by test E is at least $4 \cdot 10^{-6}$ as defined herein.

In an embodiment, the lactose-positive, galactose-negative, *Streptococcus thermophilus* strain provided in a) exhibits a ratio of the beta-galactosidase activity in said strain as assayed by test D over the glucokinase activity in said strain as assayed by test E which is less than $4 \cdot 10^{-6}$ or less than $3 \cdot 10^{-6}$ as defined herein.

The invention is also directed to a method to design a lactose-positive, galactose-negative, *Streptococcus thermophilus* strain secreting glucose, comprising:

a) providing a lactose-positive, galactose-negative, *Streptococcus thermophilus* strain, exhibiting a ratio of the beta-galactosidase activity in said strain as assayed by test D over the glucokinase activity in said strain as assayed by test E of at least $4 \cdot 10^{-6}$ as defined and releasing a glucose concentration between 8 and 50 mM when assayed by test B;

b) mutating a gene, encoding a protein of the mannose-glucose-specific PTS, in particular a manL gene, a manM gene or a manN gene, of the strain provided in a);

c) selecting from the mutants obtained in b), a lactose-positive, galactose-negative, *Streptococcus thermophilus* strain, wherein said mutant obtained in b) releases a glucose concentration of at least 60 mM, when assayed by test B. In an embodiment, said mutant obtained in b) releases a glucose concentration of at least 70 mM. In an embodiment, said mutant obtained in b) releases a glucose concentration of at least 80 mM. In an embodiment, said mutant obtained in b) releases a glucose concentration of at least 90 mM. In an embodiment, said mutant obtained in b) releases a glucose concentration of at least 100 mM.

The invention is also directed to a method to select a lactose-positive, galactose-negative *S. thermophilus* strain according to the invention, comprising:

1) to provide a lactose-positive, galactose-negative *Streptococcus thermophilus* strain expressing an original glucokinase, the activity of which is more than 1800 U/g of total protein extract as assayed by test A, in particular more than 2000 U/g of total protein extract as assayed by test A;

2) to modify the open reading frame of the glcK gene of the lactose-positive, galactose-negative *Streptococcus thermophilus* strain of step 1), such that said modified *Streptococcus thermophilus* strain expresses a glucokinase the sequence of which is modified as defined herein, as compared to the sequence of the original glucokinase;

3) to assay, by test A, the glucokinase activity in said modified *Streptococcus thermophilus* strain obtained in step 2);

4) to select a modified *Streptococcus thermophilus* strain, expressing a glucokinase the activity of which in said modified strain is reduced but not null as defined herein by test A;

5) optionally, to assay, by test C, the glucokinase Vmax in said modified *Streptococcus thermophilus* strain selected in step 4) and to select a modified *Streptococcus thermophilus* strain, expressing a glucokinase the Vmax of which in said modified strain is reduced but not null as defined herein by test C.

In an embodiment of step 2), the modification of the open reading frame of the glcK gene is carried out by directed mutagenesis of the glcK gene of the *Streptococcus thermophilus* strain of step 1). In an embodiment of step 2), the modification of the open reading frame of the glcK gene is carried out by replacing the original open reading frame of of the glcK gene of the strain of step 1) by a heterologous open reading frame of glcK gene (where "heterologous" means an open reading frame of the glcK gene which is not originally present in the strain of step 1), for example an open reading frame of the glcK gene which is synthetically designed or an open reading frame of the glcK gene obtained from another *Streptococcus thermophilus* strain).

In an embodiment of step 4), the feature "glucokinase activity in said modified strain is significantly reduced but not null" is a defined above for the definition of the lactose-positive, galactose-negative *Streptococcus thermophilus* strain of the invention. In a particular embodiment, the glucokinase activity in the modified *Streptococcus thermophilus* strain is, as assayed by test A, between 200 and 1500, between 300 and 1200 between 400 and 1000 U/g of total protein extract or is between a minimal value selected from the group consisting of 200, 300 and 400 U/g of total protein extract and a maximal value selected from the group consisting of 1000, 1200 and 1500 U/g of total protein extract, as assayed by test A. In a particular embodiment, the glucokinase activity in the modified *Streptococcus thermophilus* strain is between 5 and 60%, 10 and 50%, 15 and 40% the activity of the glucokinase activity of the DGCC7710 strain (both assayed by test A) or is between a minimal percentage selected from the group consisting of 5, 10 and 15% the glucokinase activity of the DGCC7710 strain and a maximal percentage selected from the group consisting of 40, 50 and 60% the glucokinase activity of the DGCC7710 strain (both assayed by test A). The expression "glucokinase activity of the DGCC7710 strain" is as defined above.

In a particular embodiment of step 5), the feature "glucokinase Vmax in said modified strain is significantly reduced but not null" is a defined above for the definition of the galactose-negative *Streptococcus thermophilus* strain of the invention. In a particular embodiment, the maximum forward velocity of the glucokinase in the modified *Streptococcus thermophilus* strain is between 200 and 1500, between 300 and 1200, between 400 and 1000 U/g total protein extract, as assayed by test C, or is between a minimal value selected from the group consisting of 200, 300 and 400 U/g of total protein extract and a maximal value selected from the group consisting of 1000, 1200 and 1500 U/g of total protein extract, as assayed by test C. In a particular embodiment, the Vmax of the glucokinase in the modified *Streptococcus thermophilus* strain is between 5 and 60% 10 and 50%, between 15 and 40%, the Vmax of the glucokinase of the DGCC7710 strain, when both assayed by test C, or is between a minimal percentage selected from the group consisting of 5, 10 and 15% the Vmax of the glucokinase activity of the DGCC7710 strain and a maximal percentage selected from the group consisting of 40, 50 and 60% the Vmax of the glucokinase of the DGCC7710 strain. The expression "Vmax of the glucokinase of the DGCC7710 strain" is as defined above. Various preferred features and embodiments of the present invention will now be described by way of non-limiting examples.

Material and Methods
Strains and Growth Conditions

The *S. thermophilus* strains (ST) disclosed in the present application were grown at 37° C. in M17 broth (Oxoïd, supplier reference CM0817) supplemented with 30 g/L of appropriate carbohydrate and if necessary, addition of 15 g/L Agar bacteriologic Type A (Biokar, supplier reference #A1010HA), or at 43° C. in milk (UHT semi-skimmed milk "Le Petit Vendéen"+3% milk powder BBA Lactalis). Autoclaved M17 broth was supplemented with 0.2 µm filtered lactose, sucrose, galactose or glucose. Frozen stocks of ST strains were obtained by half-diluting an overnight culture in M17 supplemented with 5 g/L lactose, and 10% glycerol, and stored at −20° C.

Quantification of Carbohydrate Catabolism During Milk Fermentation [Test B]

UHT semi-skimmed milk "Le Petit Vendéen ("yoghurt milk") containing 3% (w/v) milk powder (BBA, Lactalis), previously pasteurized 10 min at 90° C., was inoculated at 1% (v/v, about $10^7$ CFU/ml) with a culture of the *S. thermophilus* strain to be assayed (M17-carbohydrate-free resuspended cells from overnight culture grown in M17 supplemented 3% sucrose). This milk was found to contain around 175 mM of lactose. The inoculated milk flasks were statically incubated in a water bath at 43° C. during 24 h, to obtain fermented milk. TO samples and samples of fermented milk (T24 h) (5 g) were diluted in 25 g 0.025 N $H_2SO_4$, before being centrifuged at 4600 rpm for 10 minutes at 4° C. The supernatant was filtered through a 0.2 µm Nylon filter (Phenomenex, Germany, Aschaffenburg) directly into a 2 ml HPLC vial. Samples were stored at −20° C. until further analysis. Carbohydrates were quantified by high performance liquid chromatography (Agilent 1200 HPLC) equipped with a refractive index detector using an Aminex HPX-87H anion exchange column (Bio-Rad Laboratories Inc.) at 35° C., with 12.5 mM $H_2SO_4$ as the elution fluid and a flow rate of 0.6 ml $min^{-1}$. The exploitation of results was made with Chemstation reprocessing software (Agilent).

glcK Sequencing

PCR amplification of the glucokinase gene was performed using primers GlcK-F4 (5'-CAGGTATGAGTT-TAGCAACGG-3') and GlcK-R12 (5'-ATTCAC-CACGGCCTGAGAC-3'), [incubation step at 98° C., 5 min, followed by 33 cycles of 98° C., 45 s; 58° C., 30 s; 68° C., 3 min, with a final extension step at 72° C., 7 min]. The PCR products of 2788 bp were then treated with Illustra™ ExoProStar™ according to the manufacturer's instructions (GE Healthcare). Sequencing reactions were performed by using the BigDye® Terminator v3.1 Cycle Sequencing kit (Life Technologies) according to the manufacturer's instructions using an AB3500 (Applied Biosystems™), and primers listed in Table 2.

TABLE 2

Listing of primers for sequencing glcK.

| Primers | Sequences |
| --- | --- |
| GlcK-F4 | CAGGTATGAGTTTAGCAACGG |
| GlcK-R8 | AGTTCAATCTTCATCATCTCG |
| GlcK-F5 | GTAGCCACATTGTTCCTGAC |
| GlcK-R6 | TTGCTGAAGCTACAGTTTCC |
| GlcK-R4 | TAAGCAAGACTAGCAGCTCC |

TABLE 2-continued

Listing of primers for sequencing glcK.

| Primers | Sequences |
|---|---|
| GlcK-F7 | TTGCGTAGTCGTGTTGAAGG |
| GlcK-R10 | ATTGTCCCTTCATAAGCATCG |
| GlcK-F11 | CGAACTGGGTGCAGATGATG |
| GlcK-R12 | ATTCACCACGGCCTGAGAC |

Glucokinase Activity [Test A]

A fresh overnight culture of a *Streptococcus thermophilus* strain in M17 containing 30 g/L lactose was obtained and used to inoculate at 1% (vol/vol) 10 ml of fresh M17 30 g/L lactose. Cells were harvested by centrifugation (6000 g, 10 min, 4° C.) at a 600 nm optical density (OD600) of 0.8+/−0.2, washed in 5 ml cold GLCK buffer (5 mM MgCl2, 10 mM $K_2HPO_4/KH_2PO_4$ [pH 7.2]), and resuspended in 500 µl cold GLCK buffer. EDTA-free protease inhibitors "cOmplete™" (Roche, supplier reference 04693132001) was added in GLCK buffer as described by the provider. Cells were disrupted by the addition of 100 mg glass beads (150-212 µm, Sigma G1145) to 200 µl resuspended cells and oscillation at a frequency of 30 cycles/s for 6 min in a MM200 oscillating mill (Retsch, Haan, Germany). Cell debris and glass beads were removed by centrifugation (14000 g, 15 min, 4° C.), and supernatant transferred into a clean 1.5 mL centrifuge tube kept on ice. Total protein content was determined by using the FLUKA Protein Quantification Kit-Rapid (ref 51254). The glucokinase activity in the cell extracts was determined spectrophotometrically by a glucose-6-phosphate dehydrogenase (G-6PDH, EC1.1.1.49):NADPH-coupled assay (Porter et al., 1982), essentially as described by Pool et al. (2006). Each sample (5, 10 and 20 µL) was added to assay buffer (10 mM $K_2HPO_4/KH_2PO_4$ [pH 7.2], 5 mM MgCl2, 1 mM ATP, 20 mM glucose, 1 mM NADP, 1 U G-6PDH) in a 250 µL final volume, and the mixture was left for 5 min at 30° C. The optical density at 340 nm was measured for 5 minutes by using a Synergy HT multi-detection microplate reader (BIO-TEK). One unit of glucokinase corresponds to the amount of enzyme that catalyzes the phosphorylation of 1 µmole of D-glucose to D-Glucose 6-phosphate per minute under the assay conditions. Glucokinase activity was calculated as follows:

Glucokinase activity (U/g of total protein extract)=dOD× V/[dt×l×ε×Qprot], wherein:

dOD is the variation of optical density (OD) at 340 nm
V is the volume of the reaction (herein 250 µL)
dt=measurement time (in minutes)
l=optical path length (herein 0.73 cm)
ε=molar attenuation coefficient of NADPH; $H^+$ (herein 6220 cm2/µmol)
Qprot=quantity of protein in the cuvette (in g)

Measurements were triplicated for each sample, and the glucokinase specific activity values given herein under test A are the mean of three independent experiments.

Maximal Forward Velocity of GlcK [Test C]

The maximal forward velocity (Vmax) of GlcK was determined by using various concentrations of glucose (0, 5, 10, 15, 20 mM) on crude extract prepared as described in the "glucokinase activity" (test A). Measurements were triplicated for each sample, and the Vmax values given herein under test C are the mean of three independent experiments.

The linear regression representing the inverse of the specific velocity in function of the inverse of the glucose concentration gives the inverse of the maximal forward velocity at the intersection with the Y-axis of the graphic.

Milk Acidifying Performance

The acidifying properties of *S. thermophilus* strains were evaluated by recording the pH over time, during milk fermentation as described in test B. The pH was monitored for 24 hours using the CINAC system (Alliance Instruments, France; pH electrode Mettler 405 DPAS SC, Toledo, Spain) as previously described. The pH was measured and recorded every 5 minutes. Using the CINAC v2.07 software, the slope between pH 6.0 and pH 5.5 (UpH/minute) [Slope pH6-5.5] was calculated.

Transfer of the glcK Allele of the ST0 Strain into the Genome of 3 Other *S. thermophilus* Strains A 1889 bp PCR product bearing the glcK gene of the ST0 strain was obtained using primers GlcK-F1 (5'-GAAGCAGTTTGGGGTAGTAG-3') and GlcK-R2 (5'-GAGTTATCTACAGGAGCTGG-3'). The PCR product was then purified using QIAquick PCR Purification Kit (Qiagen), and eluted in RNase free water. The concentration of the PCR product was determined using NanoDrop 2000 spectrophotometer (Thermo Scientific, Wilmington, Mass.). The size and the purity of the PCR product were verified by gel-based capillary electrophoresis QIAxcel® system (Qiagen, Hilden, Germany). Strains DGCC7710, ST1.1 and ST1.2 were transformed with the 1889 bp PCR product and mutants having their glcK gene replaced by the glcK allele of the ST0 strain were selected (the presence of the glcK allele of the ST0 strain was checked by sequencing).

Results

In WO2013/160413 application and Sorensen et al. (2016), the selection of glcK mutants was performed through the selection of 2-deoxyglucose (2-DOG) resistant mutants from a collection of galactose-fermenting strains (example 2 of WO application). Three mutants have been described, CHCC15757 (also known as St1-GS-1), CHCC15887 and St2-GS-1, presenting an amino acid change in their glucokinase, respectively T141I, S72P and G249R. However, the obtained mutants have been shown to be impacted in their acidification kinetics (see example 4 below for the S72P change).

The glucokinase activity of strains expressing a glucokinase having the T141I, S72P or G249R change was reported not to be detectable (see example 4 below for the S72P change). This may explain the delayed acidification kinetics reported in WO2013/160413 application and Sørensen et al. (2016). It is hypothesized that the method used for the selection could explain the obtention of mutants only expressing a glucokinase having a null glucokinase activity (i.e., not detectable). Indeed, in a galactose-fermenting strain bearing a wild-type glucokinase, the 2-DOG will be phosphorylated by the glucokinase (GlcK), that cannot then be used as a substrate by the phosphoglucomutase (PGM). As a consequence, the 2-DOG would be toxic for the galactose-fermenting strain, as a result not only of the competition between the 2-DOG and the glucose for the binding-site of GlcK, but also of a consumption of ATP (by the glucokinase) which cannot be regenerated by the glycolysis pathway. Thus, to survive, the best option for the galactose-fermenting strain is to switch the activity of the glucokinase off. Consequently, the selection method described in WO2013/160413 application and Sorensen et al. (2016) is expected to predominantly provide galactose-fermenting strains, the glcK gene of which does not express a functional glucokinase.

Example 1: Screening of a *Streptococcus thermophilus* Collection for Glucose-Excreting Strains The inventors of the present application, with a wish to select strains secreting glucose, used another approach. A *Streptococcus thermophilus* collection was screened by test B for strains able to excrete glucose in the fermented milk. An amount of 10 mM of glucose was used as the minimal threshold for selection. One strain, ST0, releasing 30 mM of glucose in fermented milk using test B, was selected.

Example 2. Identification of a Mutation in the glcK Gene

Sequencing of several genes—of the ST0 strain known to be involved in the catabolism of carbohydrates in *S. thermophilus* was carried out and aligned with the corresponding gene sequences of other *Streptococcus thermophilus* of our collection.

A non-conservative amino acid difference, E275K, was identified in the GlcK sequence of the ST0 strain, which was not found in any of the GlcK sequence of the other *S. thermophilus* strains of the collection; this amino acid difference is the result of a A at position 823 of the glcK gene instead of a G. Further comparison of the glucokinase encoded by the glcK gene of other *S. thermophilus* strains confirmed that a lysine at position 275 (instead of a glutamic acid) was unique to ST0 and was not found in any of the 107 other strains.

Other amino acid differences identified in the deduced glucokinase from these 108 strains are represented in Table 3. Thus, 10 different glucokinase types could be distinguished (GlcK type 1 to GlcK type 10, as set forth respectively in SEQ ID NOs: 2, 4, 6, 8, 10, 12, 14, 16, 18 and 20). For the next experiments, 10 strains, ST1 to ST10, each expressing a unique glucokinase were selected. SEQ ID NO:2 was taken as a reference sequence, because this GlcK type was found in about 70% of the 108 analysed strains. In particular, the DGCC7710 strain, deposited at the DSMZ under accession number DSM28255 on Jan. 14, 2014, encodes a glucokinase as defined in SEQ ID NO:2

It is noteworthy that the only amino acid difference between the sequence of the glucokinase encoded by the ST0 strain and SEQ ID NO:2 is the amino acid difference in position 275.

TABLE 3

GlcK protein differences identified by comparison of the GlcK protein sequence encoded by 108 *S. thermophilus*, and GlcK protein sequence encoded by ST0 and ST20. The listed amino acid positions indicate all the amino acid differences between the GlcK proteins. GlcK protein sequence from ST1 (SEQ ID NO: 2) was chosen as a reference sequence. The amino acid positions not listed in this Table are identical for all the glucokinases from this study, "aa diff" column gives the number of amino acid differences as compared to SEQ ID NO: 2. "% id" column gives the percentage of identity to SEQ ID NO: 2

| aa position | 21 | 33 | 38 | 49 | 64 | 100 | 131 | 133 | 137 | 141 | 144 | 149 | 152 |
|---|---|---|---|---|---|---|---|---|---|---|---|---|---|
| ST1 | T | E | E | E | D | V | N | N | I | T | G | A | N |
| ST2 | — | — | — | — | — | — | — | — | V | — | — | — | — |
| ST3 | N | G | — | — | — | — | — | — | V | — | — | V | K |
| ST4 | — | — | — | — | A | — | — | — | — | — | — | — | — |
| ST5 | — | — | — | — | — | — | — | — | — | — | — | — | — |
| ST6 | — | — | — | — | — | — | — | — | — | — | — | — | — |
| ST7 | — | — | — | D | — | — | — | — | V | — | — | — | — |
| ST8 | N | G | — | — | — | — | — | — | V | — | — | V | K |
| ST9 | — | — | D | — | — | — | S | D | V | — | — | — | — |
| ST10 | — | — | D | — | — | I | — | D | V | — | — | — | — |
| ST0 | — | — | — | — | — | — | — | — | — | — | — | — | — |
| ST20 | — | — | — | — | — | — | — | — | — | — | — | S | — |

| aa position | 182 | 188 | 197 | 198 | 209 | 220 | 227 | 252 | 265 | 275 | aa diff. | % id. |
|---|---|---|---|---|---|---|---|---|---|---|---|---|
| ST1 | K | V | V | A | S | F | I | T | V | E | / | / |
| ST2 | — | — | — | — | — | — | — | — | — | — | 1 | 99.7 |
| ST3 | — | — | I | — | — | — | L | — | — | — | 7 | 97.8 |
| ST4 | — | — | — | — | — | — | — | — | — | — | 1 | 99.7 |
| ST5 | — | A | — | — | — | — | — | — | — | — | 1 | 99.7 |
| ST6 | N | — | — | T | — | — | — | — | — | — | 2 | 99.4 |
| ST7 | — | — | — | — | — | L | L | I | — | — | 5 | 98.4 |
| ST8 | — | — | I | — | — | — | — | — | — | — | 6 | 98.1 |
| ST9 | — | — | — | — | — | L | L | I | — | — | 7 | 97.8 |
| ST10 | — | — | — | — | — | L | L | I | I | — | 8 | 97.5 |
| ST0 | — | — | — | — | — | — | — | — | — | K | 1 | 99.7 |
| ST20 | — | — | — | — | — | — | — | — | — | — | 1 | 99.7 |

Example 3. Measurement of the Glucokinase Activity of the ST0 Strain and Comparison with Other Strains (ST1 to ST10)

The glucokinase activity of the ST0 strain was compared with the glucokinase activity of the ST1 to ST10 strains selected as reported in example 2, using test A. The results are summarized in Table 4.

TABLE 4

Glucokinase specific activity of 11 strains: 10 strains - ST1 to ST10 - each representing a different GlcK protein variant, and ST0 identified in example 1; ND: not determined

| Strain | Glucokinase specific activity (U/g total protein extract) Average | STD | relative activity (% DGCC7710) |
|---|---|---|---|
| DGCC7710 (ST1 type) | 2756 | 140 | 100 |
| ST2 | 2250 | 381 | 82 |
| ST3 | 2595 | 173 | 94 |
| ST4 | 2014 | 105 | 73 |
| ST5 | ND | ND | ND |
| ST6 | 2892 | 354 | 105 |
| ST7 | 2791 | 104 | 101 |
| ST8 | 2471 | 293 | 90 |
| ST9 | 2553 | 337 | 93 |
| ST10 | 2718 | 280 | 99 |
| ST0 | 977 | 29 | 35 |

These data show that the glucokinase activity of strains ST1 to ST10 is comprised from 2014 to 2791 U/g total protein extract as assayed by test A. A glucokinase activity above 1800 U/g total protein extract was considered to represent a normal glucokinase activity. The glucokinase activity of the DGCC7710 strain was considered as a reference glucokinase activity (since expressing the most frequent GlcK type, defined as SEQ ID NO:2).

In contrast, the ST0 strain, expressing a GlcK protein bearing a lysine at position 275 has a glucokinase activity which is around 977 U/g total protein extract as assayed by test A, i.e. is about 3 times less the glucokinase activity of the DGCC7710 strain (35%).

These data show that the approach retained by the inventors enabled to select for the first time a galactose-negative S. thermophilus strain expressing a glucokinase, the activity of which is significantly reduced but not null.

Example 4: Comparison of the Glucokinase Activity, Vmax, Km, Glucose Release and Acidification Kinetics of the DGCC7710 Strain, a DGCC7710 Derivative Bearing the E275K Difference and a Galactose-Positive Variant of DGCC7710 Bearing a Glucokinase Null Amino Acid Change To check that the glucose excreting feature of the ST0 strain is the result of the decrease of the glucokinase activity and the result of the E275K amino acid difference identified in the glucokinase, a derivative of the DGCC7710 strain was designed, into which the glcK gene encodes a glucokinase with the glutamic acid (E) at position 275 being replaced by the amino acid lysine (K). This derivative (DGCC12534) was deposited at the DSMZ on Aug. 15, 2017 under accession number DSM32587. The sequence of its GlcK protein is as defined in SEQ ID NO:22.

In parallel, a mutant of DGCC7710 was generated, into which the serine (S) at position 72 was replaced by a proline (P), to give a GlcK protein with a sequence as defined in SEQ ID NO:23 [S72P amino acid substitution; reported in strain DSM25851 of application WO2013/160413]. Because the S72P amino acid substitution leads to a null glucokinase activity (i.e. a strain which is not able to use glucose via the glucokinase), the mutant was previously rendered galactose positive (in order to be able to use galactose, because a galactose-negative S. thermophilus strain displaying a null glucokinase activity is expected to be non-viable). Thus, the gal operon promoter of the DGCC7710 strain was previously mutated according to application WO2011/026863 to give a gal operon promoter having the sequence as defined in SEQ NO:24. A galactose-positive mutant bearing the S72P amino acid substitution in the GlcK protein was obtained and called ST1m-glcK0-gal+.

An alignment of the protein sequence of the glucokinase of DGCC7710, DSM32587 and ST1m-glcK0-gal+ strains is disclosed in FIG. 1.

The glucokinase activity, the Vmax and Km of the glucokinase, the glucose release in fermented milk, and the acidification kinetics, of DGCC7710, of DSM32587 and of ST1m-glcK0-gal+. strains were determined as described in the Material and Methods. The results obtained are disclosed in Tables 5 to 7 and in FIG. 2, and summarized in Table 8.

TABLE 5

Glucokinase specific activity of DGCC7710 strain, and in DSM32587 and ST1m-glcK0-gal+ strains and % of activity as compared to the glucokinase activity of DGCC7710 strain

| Strain | Glucokinase specific activity (U/g total protein extract) Average | STD | relative activity (% DGCC7710) |
|---|---|---|---|
| DGCC7710 | 2756 | 140 | 100 |
| DSM32587 | 907 | 32 | 33 |
| ST1m-glcK0-gal+ | 0 | / | 0 |

TABLE 6

Vmax of glucokinase of DGCC7710 strain and in DSM32587 and ST1m-glcK0-gal+ strains and % of Vmax glucokinase as compared to the Vmax of glucokinase of DGCC7710 strain, and Km activity of glucokinase of DGCC7710, DSM32587 and ST1m-glcK0-gal+. strains; ND: not determined

| Strain | Vmax Glucokinase (U/g total protein extract) average | STD | % DGCC7710 | Km Glucokinase (mM) average | STD |
|---|---|---|---|---|---|
| DGCC7710 | 2855 | 178 | 100 | 1319 | 73 |
| DSM32587 | 914 | 21 | 32 | 1328 | 56 |
| ST1m-glcK0-gal+ | ND | / | ND | ND | / |

TABLE 7

Carbohydrate catabolism in milk fermented (24 h) with DGCC7710, DSM32587 or ST1m-glcK0-gal+. strain

| Strain | Lactose consumed (mM) | Glucose released (mM) | Glucose released/Lactose consumed (%) |
|---|---|---|---|
| DGCC7710 | 55 | 0 | 0 |
| DSM32587 | 83 | 29 | 35 |
| ST1m-glcK0-gal+ | 160 | 109 | 68 |

TABLE 8

Summary of the behaviour of DGCC7710, DSM32587 and ST1m-glcK0-gal+. strains; ND: not determined

| Strain | Glucokinase specific activity (U/g total protein extract) | Vm Glucokinase (U/g total protein extract) | Glucose released/ lactose consumed (%) | slope pH 6-5.5 (UpH/min) |
|---|---|---|---|---|
| DGCC7710 | 2756 | 2855 | 0 | −0.0117 |
| DSM32587 | 907 | 914 | 35 | −0.0141 |
| ST1m-glcK0-gal+ | 0 | ND | 68 | −0.0077 |

First, the data of Table 5 nicely shown that replacing the glutamic acid (E) at position 275 of the GlcK protein by a lysine (K) is sufficient alone to significantly decrease the glucokinase activity from 2756 to 907 U/g (i.e., 33% of DGCC7710 activity) in the DGCC7710 derivative (DSM32587). The data obtained for the ST1m-glcK0-gal+. mutant confirm that the S72P amino acid change is sufficient to totally abolish the glucokinase activity. Together with the glucokinase activity, the inventors also studied whether the observed decrease of glucokinase activity in the DSM32587 strain was a consequence of a decrease of the affinity (Km) of the glucokinase for its substrate (glucose) and/or a decrease in the maximum forward velocity (Vmax) of the glucokinase. The data of Table 6 confirm that replacing the glutamic acid (E) at position 275 of the GlcK protein by a lysine (K) is sufficient alone to significantly decrease the Vmax of the glucokinase from 2855 to 914 U/g (i.e., 32% of DGCC7710 Vmax) in the DGCC7710 derivative (DSM32587). In absence of a functional glucokinase in the ST1m-glcK0-gal+ mutant, the Vmax could not be determined.

The data of Table 7 show that the DSM32587 strain releases 29 mM of glucose after milk fermentation, whereas the DGCC7710 strain having a high glucokinase activity do not release significant amount of glucose; moreover, the DSM32587 strain consumes 1.5 more lactose than the DGCC7710 strain. The glucose released in the milk fermented with DSM32587 corresponds to 35% of the consumed lactose, while the glucose released in milk fermented with the DGCC7710 strain is below detection level (milk alone was found to contain 175 mM of lactose with no detectable levels of other carbohydrates or acids). These data showed that the DSM32587 strain—in which the activity of glucokinase and Vmax is about 3 times reduced as compared to the one of the DGCC7710 strain—compensates its lower intracellular glucose catabolism by consuming 1.5 more lactose, and releasing 35% of the glucose portion of the consumed lactose after 24 h. Finally, as far as ST1m-glcK0-gal+ mutant is concerned, this galactose-positive mutant consumes almost all the lactose present in milk (160 mM out of 175 mM), and excretes 109 mM of glucose, corresponding to 68% of the consumed lactose. The remaining part of glucose is hypothesized to be excreted in milk but reconsumed by the cell, after transportation via a PTS system.

Finally, the data of FIG. 2 show that the acidification kinetics of the DSM32587 strain was not significantly impacted as compared to the DGCC7710 strain (slope pH 6-5.5 of −0.0141 UpH/min for the DSM32587 strain as compared to −0.0117 UpH/min for the DGCC7710 strain). In contrast, the slope pH 6-5.5 of the ST1m-glcK0-gal+ mutant was significantly impacted (−0.0077 UpH/min).

Altogether, these data show that the more the glucokinase activity and the Vmax are decreased (up to 0), the more the strains consumed lactose and the more the amount of glucose excreted. These data confirm that the absence of a functional glucokinase, whereas providing a high amount of excreted glucose, significantly impacts the acidification kinetics in a galactose-positive S. thermophilus. The present inventors have surprisingly shown for the first time that the combination of the "galactose-negative" feature of a S. thermophilus strain and the "significantly reduced but not null glucokinase activity" feature in this strain together with the "significantly reduced but not null glucokinase Vmax" feature in this strain enables to obtain strains with glucose excreting properties (above 10 mM) in milk fermented with these strains.

Example 5: Comparison of the Glucokinase Activity, Vmax, Km, Glucose Release and Acidification Kinetics of 2 S. thermophilus Strains Expressing a Standard Glucokinase Activity and their Respective Variants Bearing the E275K Difference To check that the behaviour of a galactose-negative S. thermophilus strain—having a significantly reduced but not null glucokinase activity—on glucose release after fermentation and acidification kinetics is not limited to the genetic background of DGCC7710, the amino acid difference E275K was introduced into 2 galactose-negative S. thermophilus having 2 distinct genetic backgrounds: the ST1.1 strain and the ST1.2 strain. The respective mutants were called ST1.1m-glcK and ST1.2m-glcK. The GlcK sequence of these 2 mutants is as defined in SEQ ID NO:22.

The glucokinase activity, the Vmax and Km of the glucokinase, the glucose release in fermented milk, and the acidification kinetics, of the ST1.1m-glcK and ST1.2m-glcK mutants were determined as described in Material and methods) and compared with the ones of the ST1.1 and ST1.2 strains. The results obtained are disclosed in Tables 9 to 11 and in FIGS. 3A and 3B, and summarized in Table 12.

TABLE 9

Glucokinase specific activity of ST1.1 and ST1.2 strains and their E275K respective mutants and % of activity as compared to the glucokinase activity of DGCC7710 strain

| Strain | Glucokinase specific activity (U/g total protein extract) | | relative activity |
|---|---|---|---|
| | Average | STD | (% DGCC7710) |
| ST1.1 | 2584 | 153 | 94 |
| ST1.1m-glcK | 755 | 82 | 27 |
| ST1.2 | 2239 | 276 | 81 |
| ST1.2m-glcK | 453 | 27 | 16 |

TABLE 10

Vmax of glucokinase of ST1.1 and ST1.2 strains and their E275K respective mutants and % of Vmax of glucokinase as compared to the Vmax of glucokinase of DGCC7710 strain, and Km activity of glucokinase of ST1.1 and ST1.2 strains and their E275K respective mutants

| Strain | Vmax Glucokinase (U/g total protein extract) | | | Km Glucokinase(mM) | |
|---|---|---|---|---|---|
| | average | STD | % DGCC7710 | average | STD |
| ST1.1 | 2687 | 172 | 94 | 2011 | 428 |
| ST1.1m-glcK | 795 | 130 | 28 | 1923 | 665 |
| ST1.2 | 2431 | 316 | 85 | 2532 | 60 |
| ST1.2m-glcK | 501 | 32 | 18 | 2397 | 452 |

TABLE 11

Carbohydrate catabolism in milk fermented (24 h) with the ST1.1 strain, the ST1.2 strain and their E275K respective mutants

| Strain | Lactose consumed (mM) | Glucose released (mM) | Glucose released/ Lactose consumed (%) |
|---|---|---|---|
| ST1.1 | 54 | 1 | 1 |
| ST1.1m-glcK | 86 | 30 | 35 |
| ST1.2 | 54 | 0 | 1 |
| ST1.2m-glcK | 69 | 18 | 26 |

TABLE 12

Summary of the behaviour of ST1.1 and ST1.2 strains and their E275K respective mutants

| Strain | Glucokinase specific activity (U/g total protein extract) | Vm Glucokinase | Glucose released/ lactose consumed (%) | slope pH 6-5.5 (UpH/min) |
|---|---|---|---|---|
| ST1.1 | 2584 | 2687 | 1 | −0.0160 |
| ST1.1m-glcK | 755 | 795 | 35 | −0.0169 |
| ST1.2 | 2239 | 2431 | 1 | −0.0136 |
| ST1.2m-glcK | 453 | 501 | 26 | −0.0150 |

First, the data of Table 9 nicely showed that replacing the glutamic acid (E) at position 275 of the GlcK protein by a lysine (K) is sufficient alone to decrease the glucokinase activity from 2584 to 755 U/g in the genetic background of ST1.1 (i.e. a glucokinase activity which is 27% the one of DGCC7710) and from 2239 to 453 U/g in the genetic background of ST1.2 respectively (i.e., a glucokinase activity which is 16% the one of DGCC7710). A similar observation was done for the Vmax of the glucokinase, for which the replacement of the glutamic acid (E) at position 275 of the GlcK protein by a lysine (K) leaded to a decrease of the Vmax of the glucokinase from 2687 to 795 U/g in the genetic background of ST1.1 (i.e. 28% of DGCC7710) and from 2431 to 501 in the genetic background of ST1.2 respectively (i.e., 18% of DGCC7710) (Table 10).

The data of Table 11 show that strains ST1.1m-glcK and ST1.2m-glcK—having a significantly reduced but not null glucokinase activity and a significantly reduced but not null Vmax—release 30 and 18 mM of glucose respectively after milk fermentation, whereas the ST1.1 and ST1.2 strains—having a high glucokinase activity—do not release significant amount of glucose. Moreover, the ST1.1m-glcK and ST1.2m-glcK strains consume 1.6 and 1.3 more lactose than the strains ST1.1 and ST1.2 strains respectively. The glucose released in the milk fermented with strains ST1.1m-glcK and ST1.2m-glcK correspond to 35% and 26% respectively of the consumed lactose, while the glucose released in milk fermented with the ST1.1 and ST1.2 strains is below detection level or very close to zero. These data showed that the ST1.1m-glcK and ST1.2m-glcK—in which the activity of glucokinase and Vmax is at least 3 times reduced as compared to the ones of the ST1.1 and ST1.2 strains—compensates their lower intracellular glucose catabolism by consuming between 1.3 and 1.6 more lactose, and releasing between 26 and 35% of the glucose portion of the consumed lactose after 24 h.

Finally, the data of FIG. 3 show that the acidification kinetics of the ST1.1m-glcK and ST1.2m-glcK strains was not significantly impacted as compared to as compared to the ST1.1 and ST1.2 strains respectively (slope pH 6-5.5 of −0.0169 UpH/min for the ST1.1m-glcK strain as compared to −0.0160 UpH/min for the ST1.1 strain, and slope pH 6-5.5 of −0.0150 UpH/min for the ST1.2m-glcK strain as compared to −0.0136 UpH/min for the ST1.1 strain).

Altogether, these data confirm that the introduction of the E275K difference in the GlcK protein of 2 galactose-negative S. thermophilus strains with distinct genetic backgrounds is sufficient to provide a fermented milk with interesting level of glucose.

In conclusion, this application is the first to report that the combination of the "galactose-negative" feature in a S. thermophilus strain with the "significantly reduced but not null glucokinase activity" feature in this strain together with the "significantly reduced but not null glucokinase Vmax" feature in this strain, enables to obtain lactose-positive, galactose-negative, S. thermophilus strains which are usable to provide fermented milk with released/accumulated glucose.

Example 6: Identification of a Further GlcK Mutated Protein

A Streptococcus thermophilus strain (ST20) was identified, the glcK gene of which contains a non-conservative amino acid difference, G144S. This amino acid change was not found in any of the GlcK sequence of the other S. thermophilus strains of the collection (GlcK types ST1 to ST10). It is noteworthy that the only amino acid difference between the sequence of the glucokinase encoded by the ST20 strain and SEQ ID NO:2 is the amino acid difference in position 144 (Table 3).

Example 7: Characterization of the Ratio of the Beta-Galactosidase Activity Over the Glucokinase Activity in glcK Mutants Several patent applications (WO2015/0149940, WO2013/160413 and WO2017/103051) report Streptococcus thermophilus strains releasing glucose. However, the strains disclosed in these applications are galactose-positive strains, a phenotype which is not necessarily desired and has been shown to be unstable, in particular when strains are cultivated on lactose-containing medium.

As mentioned above, the results indicate that glucokinase activity in a strain (which is reduced but not null as defined herein) is an interesting parameter to identify Streptococcus thermophilus strains releasing glucose. However, this parameter can be insufficient, when used alone, to identify Streptococcus thermophilus releasing glucose mutated in other gene(s) than the glcK gene.

Thus, the inventors have observed and checked that, more than the glucokinase activity alone, the ratio of the beta-galactosidase activity over the glucokinase activity was an excellent parameter, not only to identify Streptococcus thermophilus releasing glucose mutated in their glcK gene, but also to identify Streptococcus thermophilus releasing glucose mutated in other genes.

Thus, this ratio was calculated by:
- determining the beta-galactosidase activity (U/g protein) in a strain, by test D
- determining the glucokinase activity (U/g protein) in said same strain, by test E; and
- calculating the ratio of beta-galactosidase activity over the glucokinase activity in said strain.

This ratio was calculated in the DGCC7710 strain, the DSM32587 strain (carrying the E275K mutation in its glcK gene), the ST1.1 strain, the ST1.1 m-glcK strain (carrying the E275K mutation in its glcK gene), the ST20 strain (carrying the G144S mutation in its glcK gene) and the ST5 strain. It is noteworthy that, in absence of a functional glucokinase in the ST1 m-glcK0-gal+ mutant (GlcK activity less than 0.1), this ratio could not be determined. The results are summarized in Table 13 and FIG. 4.

The glucose release in fermented milk and the acidification kinetics of these 6 strains were also determined as described in Material and methods, and summarized in Table 14, and compared with the behaviour of the ST1m-glcK0-gal+.

glucokinase activity which is equals to or more than $9 \cdot 10^{-6}$, whereas all strains for which the level of glucose is not detectable exhibit a ratio beta-galactosidase activity over glucokinase activity which is about 2 to 3 $10^{-6}$.

This confirms that the ratio beta-galactosidase activity over glucokinase activity (as calculated herein) is an excellent parameter to identify lactose-positive galactose-negative Streptococcus thermophilus strains releasing significant amount of glucose.

Example 8: Characterization of the Ratio of the Beta-Galactosidase Activity Over the Glucokinase Activity in a ccpA Mutant Based on the conclusion of example 7, the inventors have determined the beta-galactosidase activity (test D) over the glucokinase activity (test E) of lactose-positive galactose-negative Streptococcus thermophilus strains (not mutated in their glcK gene) of the DuPont proprietary collection.

One strain (ST30) has been shown to exhibit such a ratio. The sequencing of the genome of this strain has revealed a mutation in the ccpA gene: the deletion of a nucleotide A in the stretch of 7 nucleotides A at positions 114-120 (SEQ ID NO:71), leading to a frameshift of the open reading frame of the ccpA gene.

This mutation was introduced into the background of the DGCC7710 strain to give the ST1 m-ccpA strain (i.e., a first DGCC7710 derivative was designed into which the ccpA gene of the DGCC7710 strain was replaced by the mutated ccpA gene as defined in SEQ ID NO:71). The same mutation was introduced into the background of the ST1.1 strain, to give the ST1.1 m-ccpA strain. This mutation was also introduced into DSM32587 (i.e. the DGCC7710 carrying a mutated glcK gene coding for a glucokinase with the substitution E275K), to give ST1m-glck+ccpA.

The ratio of the beta-galactosidase activity over the glucokinase activity was calculated in the DGCC7710 strain, the ST1 m-ccpA strain, the ST1.1 strain and the ST1.1 m-ccpA strain. The results are summarized in Table 15 and FIG. 4. The glucose release in fermented milk and the acidification kinetics of these 4 strains were also determined as described in Material and methods, and summarized in Table 16.

TABLE 13

Summary of the ratio of beta-galactosidase activity over the glucokinase activity in the DGCC7710, DSM32587, ST1.1, ST1.1m-glcK, ST20 and ST5 strains

| Strain | Glck activity (U/g protein) Average | STD | Beta Gal activity (U/g protein) Average | STD | ratio beta-galactosidase activity/ glucokinase activity |
|---|---|---|---|---|---|
| DGCC7710 | 1692 | 298 | $5.20 \times 10^{-3}$ | $1.19 \times 10^{-3}$ | $3.07 \times 10^{-6}$ |
| DSM32587 | 876 | 126 | $9.95 \times 10^{-3}$ | $3.92 \times 10^{-4}$ | $1.14 \times 10^{-5}$ |
| ST1.1 | 1425 | 189 | $3.57 \times 10^{-3}$ | $2.77 \times 10^{-4}$ | $2.50 \times 10^{-6}$ |
| ST1.1m-glcK | 520 | 55 | $6.01 \times 10^{-3}$ | $3.82 \times 10^{-4}$ | $1.16 \times 10^{-5}$ |
| ST20 | 889 | 99 | $8.01 \times 10^{-3}$ | $2.01 \times 10^{-4}$ | $9.01 \times 10^{-6}$ |
| ST5 | 1168 | 89 | $3.09 \times 10^{-3}$ | $1.88 \times 10^{-4}$ | $2.64 \times 10^{-6}$ |

TABLE 14

Summary of the behaviour of the DGCC7710, DSM32587, ST1.1, ST1.1 m-glcK, ST20, ST5 and ST1m-glcK0-gal+ strains

| Strain | ratio beta-galactosidase activity/ glucokinase activity | Glucose release (mM) (test B) | Slope pH 6-5.5 (UpH/min) |
|---|---|---|---|
| DGCC7710 | $3.07 \times 10^{-6}$ | <0.1 | −0.0140 |
| DSM32587 | $1.14 \times 10^{-5}$ | 32 | −0.0148 |
| ST1.1 | $2.50 \times 10^{-6}$ | <0.1 | −0.0180 |
| ST1.1m-glcK | $1.16 \times 10^{-5}$ | 35 | −0.0168 |
| ST20 | $9.01 \times 10^{-6}$ | 49 | −0.0121 |
| ST5 | $2.64 \times 10^{-6}$ | <0.1 | −0.0065 |
| ST1m-glcK0-gal+ | / | 68 | −0.0077 |

These data show that all the strains releasing glucose (at least 32 mM) exhibit a ratio beta-galactosidase activity over

TABLE 15

Summary of the ratio of beta-galactosidase activity over the glucokinase activity in the DGCC7710, the ST1 m-ccpA, the ST1.1 and the ST1.1 m-ccpA strains

| Strain | Glck activity (U/g protein) Moy | SD | Beta Gal activity (U/g protein) Moy | SD | ratio beta-galactosidase activity/ glucokinase activity |
|---|---|---|---|---|---|
| DGCC7710 | 1692 | 298 | $5.20 \times 10^{-3}$ | $1.19 \times 10^{-3}$ | $3.07 \times 10^{-6}$ |
| ST1m-ccpA | 1871 | 310 | $1.84 \times 10^{-2}$ | $2.25 \times 10^{-3}$ | $9.82 \times 10^{-6}$ |
| ST1.1 | 1425 | 189 | $3.57 \times 10^{-3}$ | $2.77 \times 10^{-4}$ | $2.50 \times 10^{-6}$ |
| ST1.1m-ccpA | 1701 | 290 | $1.03 \times 10^{-2}$ | $1.44 \times 10^{-3}$ | $6.07 \times 10^{-6}$ |

TABLE 16

Summary of the behaviour of the DGCC7710, the ST1m-ccpA, the ST1m-KOccpA, the ST1m-glcK+ccpA, the ST1.1 and the ST1.1m-ccpA strains (nd: not determined)

| Strain | ratio beta-galactosidase activity/ glucokinase activity | Glucose (mM) | Slope pH 6-5.5 (UpH/min) |
|---|---|---|---|
| DGCC7710 | $3.07 \times 10^{-6}$ | <0.1 | −0.0140 |
| ST1m-ccpA | $9.82 \times 10^{-6}$ | 12 | −0.0125 |
| ST1m-KOccpA | nd | 28 | −0.0084 |
| ST1m-glcK + ccpA | nd | 39 | −0.0100 |
| ST1.1 | $2.50 \times 10^{-6}$ | <0.1 | −0.0180 |
| ST1.1m-ccpA | $6.07 \times 10^{-6}$ | 14 | −0.0160 |

First, these data confirm that the identified ccpA mutation leads to a strain exhibiting a ratio of the beta-galactosidase activity over the glucokinase activity of 6 and 9.8 $10^{-6}$, whereas the strains not mutated in the ccpA gene exhibit a ratio of the beta-galactosidase activity over the glucokinase activity of $2.5 \cdot 10^{-6}$ and $3.10^{-6}$. Then, these data also confirm that the strains carrying the mutated ccpA mutation release glucose during milk fermentation, in contrast to the strains not mutated in the ccpA gene. Finally, these data also show that acidification kinetics of the strains carrying the mutated ccpA mutation is not impacted.

Altogether, these results confirm that the ratio of the beta-galactosidase activity over the glucokinase activity as defined herein is an excellent parameter to identify lactose-positive galactose-negative *Streptococcus thermophilus* strains releasing significant amount of glucose.

The results also show that the inventors have identified, in addition to the mutations of the glcK gene coding for a glucokinase, the activity of which is reduced but not null, another gene—the ccpA gene—which can be mutated (but not knocked-out) to give a strain releasing glucose and having a good acidification kinetics. The behavior of the DGCC7710 strain bearing a mutated ccpA gene (SEQ ID NO:71) [ST1 m-ccpA] was compared with the behaviour of a DGCC7710 derivative into which the ccpA gene of the DGCC7710 strain was knocked-out (ST1 m-KOccpA). Interestingly, this comparison shows that the ST1 m-KOccpA is significantly impacted in its acidification kinetics, whereas the ST1 m-ccpA strain is not (Table 16), showing that the mutation of the ccpA gene in the ST1 m-ccpA strain is different from a pure knock-out of the gene.

Finally, the introduction of both mutated glcK gene and mutated ccpA gene in the DGCC7710 strain shows an amount of glucose (39 mM) which is increased as compared to the DSM32587 strain (Table 14) and to the ST1m-ccpA strain.

Example 9: Characterization of the Ratio of the Beta-Galactosidase Activity Over the Glucokinase Activity in Strains Mutated in the manL Gene, and in Both the ccpA and manL genes, and comparison with the ratio in strains mutated in the glcK gene or the ccpA Gene In further experiments, the inventors have identified a lactose-positive galactose-negative *Streptococcus thermophilus* strains (not mutated in its glcK gene) carrying a mutation in the manL gene (gene encoding the IIAB$^{Man}$ protein, protein which is part of the mannose-glucose-specific PTS). The mutation of the manL gene is the substitution of the nucleotide G in the nucleotide T at position 916, leading to a stop codon at position 306 of the protein [IIAB$^{Man}_{305}$] (SEQ ID NO:155).

This mutation was introduced into the background of the DGCC7710 strain to give the ST1 m-manL strain; the same mutation was introduced into the background of the ST1.1 strain, to give the ST1.1 m-manL strain. In addition, the manL mutated gene was introduced into the ST1 m-ccpA strain and the ST1.1 m-ccpA strain detailed in example 8 (i.e., strains DGCC7710 and ST1.1 bearing a mutated ccpA gene).

The ratio of the beta-galactosidase activity over the glucokinase activity was calculated in the DGCC7710 strain, the ST1 m-manL strain, the ST1 m-ccpA strain, the ST1 m-ccpA+manL strain, the ST1.1 strain, the ST1.1 m-manL strain, the ST1.1 m-ccpA strain and the ST1.1m-ccpA+manL strain. The results are summarized in Table 17 and FIG. 4. The glucose release in fermented milk and the acidification kinetics of these 8 strains were also determined as described in Material and methods, and summarized in Table 18.

TABLE 17

Summary of the ratio of beta-galactosidase activity over the glucokinase activity in the DGCC7710, the ST1m-manL, the ST1m-ccpA, the ST1m-ccpA + manL, the ST1.1, the ST1.1m-manL, the ST1.1m-ccpA and the ST1.1m-ccpA + manL strains

| strain | Gene(s) mutated | Glck activity (U/g protein) Average | STD | Beta Gal activity (U/g protein) Average | STD | ratio beta-galactosidase activity/ glucokinase activity |
|---|---|---|---|---|---|---|
| DGCC7710 | / | 1692 | 298 | $5.20 \times 10^{-3}$ | $1.19 \times 10^{-3}$ | $3.07 \times 10^{-6}$ |
| ST1m-ccpA | ccpA | 1871 | 310 | $1.84 \times 10^{-2}$ | $2.25 \times 10^{-3}$ | $9.82 \times 10^{-6}$ |

TABLE 17-continued

Summary of the ratio of beta-galactosidase activity over the glucokinase activity in the DGCC7710, the ST1m-manL, the ST1m-ccpA, the ST1m-ccpA + manL, the ST1.1, the ST1.1m-manL, the ST1.1m-ccpA and the ST1.1m-ccpA + manL strains

| strain | Gene(s) mutated | Glck activity (U/g protein) Average | STD | Beta Gal activity (U/g protein) Average | STD | ratio beta-galactosidase activity/ glucokinase activity |
|---|---|---|---|---|---|---|
| ST1m-manL | manL | 1667 | 147 | $4.24 \times 10^{-3}$ | $1.89 \times 10^{-4}$ | $2.54 \times 10^{-6}$ |
| ST1m-ccpa + manL | ccpA + manL | 1765 | 129 | $1.61 \times 10^{-2}$ | $4.76 \times 10^{-4}$ | $9.11 \times 10^{-6}$ |
| ST1.1 | / | 1425 | 189 | $3.57 \times 10^{-3}$ | $2.77 \times 10^{-4}$ | $2.50 \times 10^{-6}$ |
| ST1.1m-ccpA | ccpA | 1701 | 290 | $1.03 \times 10^{-2}$ | $1.44 \times 10^{-3}$ | $6.07 \times 10^{-6}$ |
| ST1.1m-manL | manL | 1413 | 148 | $3.27 \times 10^{-3}$ | $1.99 \times 10^{-4}$ | $2.32 \times 10^{-6}$ |
| ST1m-ccpa + manL | ccpA + man | 1547 | 120 | $1.47 \times 10^{-2}$ | $2.43 \times 10^{-3}$ | $9.49 \times 10^{-6}$ |

TABLE 18

Summary of the behaviour of the DGCC7710, the ST1m-manL, the ST1m-ccpA, the ST1m-ccpA + manL, the ST1.1, the ST1.1m-manL, the ST1.1m-ccpA and the ST1.1m-ccpA + manL strains

| Strain | Mutated gene(s) | Ratio | Glucose (mM) | Slope pH 6-5.5 (UpH/min) |
|---|---|---|---|---|
| DGCC7710 | / | $3.07 \times 10^{-6}$ | <0.1 | −0.0140 |
| ST1m-ccpA | ccpA | $9.82 \times 10^{-6}$ | 12 | −0.0125 |
| ST1m-manL | manL | $2.54 \times 10^{-6}$ | 17 | −0.0104 |
| ST1m-ccpa + manL | ccpA + manL | $9.11 \times 10^{-6}$ | 124 | −0.0089 |
| ST1.1 | / | $2.50 \times 10^{-6}$ | <0.1 | −0.0180 |
| ST1.1m-ccpA | ccpa | $6.07 \times 10^{-6}$ | 14 | −0.0160 |
| ST1.1m-manL | manL | $2.32 \times 10^{-6}$ | 7 | −0.0123 |
| ST1.1m-ccpa + manL | ccpa + manL | $9.49 \times 10^{-6}$ | 107 | −0.0091 |

First, these data show that strains mutated in their manL gene only (ST1 m+manL or ST1.1 m-manL) release glucose during milk fermentation, though they do not exhibit a ratio of the beta-galactosidase activity over the glucokinase activity which is more or less similar to the DGCC7710 or ST1.1 strain. This show that the manL mutation does not impact the activity of the glucokinase and/or the activity of the beta-galactosidase in Streptococcus thermophilus strains.

These data also show that strains mutated both in their ccpA gene and manL gene (ST1 m-ccpA+manL and ST1.1 m-ccpA+manL strains) exhibit a ratio beta-galactosidase activity over the glucokinase activity which is similar or higher than the strains mutated in the ccpA gene only (ST1 m-ccpA and ST1.1 m-ccpA strains). This confirms that the ratio beta-galactosidase activity over the glucokinase activity (as defined herein) can be used to generate and identify further mutations in the glcK gene, ccpA gene and man genes, by combining these mutated gene(s) to be assayed with glcK gene, ccpA gene or man gene(s) with known mutations (and determining the ratio).

Interestingly, the double (ccpA+manL) mutants release glucose in concentration higher than 100 mM, and which are 7 to 10 times the glucose concentration of the ST1 m-ccpA and ST1.1m-ccpA strains. These data show that there is a synergy with regards to the concentration of glucose released [the concentration of glucose released using the double mutant being far more than the addition of the concentration of glucose released using the ccpA-mutated strains and the concentration of glucose released using the manL-mutated strains]. Though the acidification kinetics of these double mutated strains is impacted, the concentration of glucose released during fermentation renders these double mutated strains industrially useful. These data confirm that the ratio beta-galactosidase activity over the glucokinase activity (as defined herein) can be used to identify lactose-positive galactose-negative Streptococcus thermophilus strains releasing significant amount of glucose.

Finally, the link put in evidence herein between the ratio of the beta-galactosidase activity over the glucokinase activity and the release of glucose during milk fermentation, can be used to identify further genes, the mutation of which leads to a ratio as defined herein, with the aim of designing more lactose-positive galactose-negative Streptococcus thermophilus strains releasing glucose.

Example 10: Glucose Release of Various Mutated Lactose-Positive Galactose-Negative Streptococcus thermophilus Strains Based on the identification of a manL mutation enhancing the glucose release effect of a mutated ccpA gene in lactose-positive galactose-negative Streptococcus thermophilus strains, the inventors identified other mutations in manM (encoding the IIC$^{Man}$ protein) and ManN (encoding the IID$^{Man}$ protein):

the mutated manM gene with a substitution of the nucleotide G in the nucleotide T at position 625, leading to a stop codon at position 209, as defined in SEQ ID NO:201;

the mutated manN gene with an insertion of a nucleotide A in the stretch of 5 nucleotides A at positions 37-41 (leading to a stretch of 6 nucleotides A, a frameshift and a truncation of the IID$^{Man}$ protein at position 28), as defined in SEQ ID NO:250;

Double-mutated and triple-mutated strains, based on the following mutated genes, were designed, in the background of DGCC7710 (ST1) or in the background of ST1.1.

ST1 m-manM: DGCC7710 derivative, into which the manM gene of the DGCC7710 strain was replaced by the mutated manM gene as defined in SEQ ID NO:201;

ST1 m-manN: DGCC7710 derivative, into which the manN gene was replaced by the mutated manN gene as defined in SEQ ID NO:250;

ST1m-glck+manM: DSM32587 derivative (carrying the glcK gene encoding a glucokinase with the substitution E275K; example 2), into which the manM gene was replaced by the mutated manM gene as defined in SEQ ID NO:201;

ST1 m-ccpA+manM: ST1 m-ccpA derivative (DGCC7710 carrying the mutated ccpA gene as defined in SEQ ID NO:71; example 8), into which the manM gene was replaced by the mutated manM gene as defined in SEQ ID NO:201;

ST1 m-ccpA+manN: ST1m-ccpA derivative, into which the manN gene was replaced by the mutated manN gene as defined in SEQ ID NO:250;

ST1 m-glcK+ccpA+manM: DSM32587 derivative, into which the ccpA gene was replaced by the mutated ccpA gene as defined in SEQ ID NO:71 and the manM gene was replaced by the mutated manM gene as defined in SEQ ID NO:201; and ST1.1 m-glcK+manM: ST1.1 m-glcK derivative (ST1.1 strain carrying the glcK gene encoding a glucokinase with the substitution E275K; example 2), into which the manM gene was replaced by the mutated manM gene as defined in SEQ ID NO:201.

The glucose release in fermented milk and the acidification kinetics of these 7 additional strains and the strains disclosed in the previous examples were determined as described in Material and methods, and summarized in Table 19.

TABLE 19

Summary of the behaviour of the DGCC7710, the ST1.1 strains and their mutants (nd: not determined)

| Strain | Mutated gene(s) | Glucose (mM) | Slope pH 6-5.5 (UpH/min) |
|---|---|---|---|
| DGCC7710 | / | <0.1 | −0.0140 |
| DSM32587 | Glck275 | 32 | −0.0148 |
| ST1m-ccpA | ccpA | 12 | −0.0125 |
| ST1m-glcK + ccpA | Glck275 + ccpA | 39 | −0.0100 |
| ST1m-manL | manL | 17 | −0.0104 |
| ST1m-manM | manM | 18 | −0.0089 |
| ST1m-manN | manN | 13 | −0.0095 |
| ST1m-glck + manM | Glck275 + manM | 112 | −0.0104 |
| ST1m-ccpa + manL | ccpA + manL | 124 | −0.0089 |
| ST1m-ccpA + manM | ccpA + manM | 124 | −0.0082 |
| ST1m-ccpA + manN | ccpA + manN | 123 | −0.0109 |
| ST1m-glcK + ccpA + manM | Glck275 + ccpA + manM | 125 | −0.0092 |
| ST20 | Glck144 | 49 | −0.0124 |
| ST1.1 | / | <0.1 | −0.0180 |
| ST.1.1m-glcK | Glck275 | 35 | −0.0168 |
| ST1.1m-ccpA | ccpa | 14 | −0.0160 |
| ST1.1m-manL | manL | 7 | −0.0123 |
| ST1.1m-glcK + manM | glcK275 + manM | 89 | −0.0140 |
| ST1.1m-ccpa + manL | ccpa + manL | 107 | −0.0091 |

These data show that, whereas the single man (manL, manM or ManN) mutants release glucose between 7 and 18 mM, the introduction of these mutated manL, manM or ManN genes in strains carrying mutations in the glcK gene and/or in the ccpA gene leads to double or triple mutants releasing between 89 and up to 125 mM of glucose. These observations confirm the enhancer effect of the mutated man genes on glucose release.

These data also confirm that mutated genes can be successfully identified using the beta-galactosidase activity over the glucokinase activity as defined herein, and then combined to design strains releasing significant amount of glucose during milk fermentation. The determination that this ratio is an excellent parameter linked to glucose release open the way not only for generation and identification of further mutations in the glcK gene, the ccpA gene, the manL gene, the manM gene and the manN gene, but also in any other gene of interest (as long as the minimal value of the ratio as defined is reached).

SEQUENCES

SEQ ID NO: 2
MSKKLLGIDLGGTTVKFGILTADGEVQEKWAIETNTFENGSHIVPDIVES

LKHRLELYGLTAEDFIGIGMGSPGAVDRENKTVTGAFNLNWAETQEVGSV

IEKELGIPFAIDNDANVAALGERWVGAGANNRNVVFITLGTGVGGGVIAD

GNLIHGVAGAGGEIGHIIVEPDTGFECTCGNKGCLETVASATGIVRVAHH

LAEKYEGNSSIKAAVDNGEFVTSKDIIVAATEGDKFADSIVDKVSKYLGL

ATANISNILNPDSVVIGGGVSAAGEFLRSRVEGYFTRYAFPQVRRTTKVK

LAELGNDAGIIGAASLAYSIDK

SEQ ID NO: 22
MSKKLLGIDLGGTTVKFGILTADGEVQEKWAIETNTFENGSHIVPDIVES

LKHRLELYGLTAEDFIGIGMGSPGAVDRENKTVTGAFNLNWAETQEVGSV

IEKELGIPFAIDNDANVAALGERWVGAGANNRNVVFITLGTGVGGGVIAD

GNLIHGVAGAGGEIGHIIVEPDTGFECTCGNKGCLETVASATGIVRVAHH

LAEKYEGNSSIKAAVDNGEFVTSKDIIVAATEGDKFADSIVDKVSKYLGL

ATANISNILNPDSVVIGGGVSAAGKFLRSRVEGYFTRYAFPQVRRTTKVK

LAELGNDAGIIGAASLAYSIDK

SEQ ID NO: 45
MSKKLLGIDLGGTTVKFGILTADGEVQEKWAIETNTFENGSHIVPDIVES

LKHRLELYGLTAEDFIGIGMGSPGAVDRENKTVTGAFNLNWAETQEVGSV

IEKELGIPFAIDNDANVAALGERWVGAGANNRNVVFITLGTGVSGGVIAD

GNLIHGVAGAGGEIGHIIVEPDTGFECTCGNKGCLETVASATGIVRVAHH

LAEKYEGNSSIKAAVDNGEFVTSKDIIVAATEGDKFADSIVDKVSKYLGL

ATANISNILNPDSVVIGGGVSAAGEFLRSRVEGYFTRYAFPQVRRTTKVK

LAELGNDAGIIGAASLAYSIDK

SEQ ID NO: 23
MSKKLLGIDLGGTTVKFGILTADGEVQEKWAIETNTFENGSHIVPDIVES

LKHRLELYGLTAEDFIGIGMGPPGAVDRENKTVTGAFNLNWAETQEVGSV

IEKELGIPFAIDNDANVAALGERWVGAGANNRNVVFITLGTGVGGGVIAD

GNLIHGVAGAGGEIGHIIVEPDTGFECTCGNKGCLETVASATGIVRVAHH

LAEKYEGNSSIKAAVDNGEFVTSKDIIVAATEGDKFADSIVDKVSKYLGL

ATANISNILNPDSVVIGGGVSAAGEFLRSRVEGYFTRYAFPQVRRTTKVK

LAELGNDAGIIGAASLAYSIDK

SEQ ID NO: 65
ATGAATACTGATGAAACAATCACAATTTATGATGTAGCGCGTGAAGCTGG

AGTATCGATGGCAACTGTTTCTCGTGTTGTAAATGGTAACAAAAACGTAA

AAGAAAACACCCGAAAAAAGTGCTCGAAGTCATTGATCGTTTGGATTAC

CGTCCAAATGCGGTTGCGCGTGGCTTGGCAAGTAAAAAAACAACTACTGT

AGGAGTTGTCATTCCAAATATTGTAAATAGCTATTTTGCTACTCTAGCTA

AAGGTATTGATGACATTGCAACCATGTATAAGTATAATATTGTTCTTGCT

-continued

TCCAGTGATGATAATGAGGATCATGAAGTTACAGTCATTCATTCTCTAAT

TTCTAAACAAGTTGATGGTATTATTTTTATGGGACACCATCTGACAGAAA

AAATCCGTGCAGAATTCTCTCGTACCCGTACACCGATTGTTCTAGCAGGA

ACAGTTGATCTCGAACACCAATTACCAAGTGTTAACATCGACTATAAAGC

TGCCGTTGAGGATTGTGTAACGCAACTTGCTAAAAATAATGAAAAGGTTG

CCTTTGTATCAGGACCACTAATTGATGATATTAATGGCAAACTACGTTTG

GCCGGGTATAAGTCTGGACTTGAAAAGAATAATTTGAGCTACAACGAAGG

ACTTGTCTTTGAAGCTAAATATAGCTATAAAGACGGCTTTGAGTTAGCAC

AACGTGTCTTGAACTCTGGTGCCACTGCTGCCTATGTTGGGGAAGATGAA

TTGGCTGCAGGTCTCTTGAATGGCCTCTTTGCTGCAGGCAAATCAGTTCC

AGAAGATTTCGAAATCATCACAAGCAATGATTCACCGGTTACAAGCTACA

CACGTCCAAACCTTTCTAGTATAAACCATCCTCTCTATGATTTAGGGGCA

GTTAGCATGCGTATGTTGACTAAAATTATGCATAAGGAAGAACTTGAAGA

TAAAGACGTTATTCTTAATCATGGTCTAACTTTACGCCAGTCAACAAAAT

AA

SEQ ID NO: 71

ATGAATACTGATGAAACAATCACAATTTATGATGTAGCGCGTGAAGCTGG

AGTATCGATGGCAACTGTTTCTCGTGTTGTAAATGGTAACAAAAACGTAA

AAGAAAACACCCGAAAAAAGTGCTCGAAGTCATTGATCGTTTGGATTACC

GTCCAAATGCGGTTGCGCGTGGCTTGGCAAGTAAAAAAACAACTACTGTA

GGAGTTGTCATTCCAAATATTGTAAATAGCTATTTTGCTACTCTAGCTAA

AGGTATTGATGACATTGCAACCATGTATAAGTATAATATTGTTCTTGCTT

CCAGTGATGATAATGAGGATCATGAAGTTACAGTCATTCATTCTCTAATT

TCTAAACAAGTTGATGGTATTATTTTTATGGGACACCATCTGACAGAAAA

AATCCGTGCAGAATTCTCTCGTACCCGTACACCGATTGTTCTAGCAGGAA

CAGTTGATCTCGAACACCAATTACCAAGTGTTAACATCGACTATAAAGCT

GCCGTTGAGGATTGTGTAACGCAACTTGCTAAAAATAATGAAAAGGTTGC

CTTTGTATCAGGACCACTAATTGATGATATTAATGGCAAACTACGTTTGG

CCGGGTATAAGTCTGGACTTGAAAAGAATAATTTGAGCTACAACGAAGGA

CTTGTCTTTGAAGCTAAATATAGCTATAAAGACGGCTTTGAGTTAGCACA

ACGTGTCTTGAACTCTGGTGCCACTGCTGCCTATGTTGGGGAAGATGAAT

TGGCTGCAGGTCTCTTGAATGGCCTCTTTGCTGCAGGCAAATCAGTTCCA

GAAGATTTCGAAATCATCACAAGCAATGATTCACCGGTTACAAGCTACAC

ACGTCCAAACCTTTCTAGTATAAACCATCCTCTCTATGATTTAGGGGCAG

TTAGCATGCGTATGTTGACTAAAATTATGCATAAGGAAGAACTTGAAGAT

AAAGACGTTATTCTTAATCATGGTCTAACTTTACGCCAGTCAACAAAATA

A

SEQ ID NO: 122

MGIGIIIASHGRFAEGIHQSGSMIFGDQEKVQVVTFMPSEGPDDLYAHEN

NAIAQFDVDDEILVLADLWSGSPFNQASRIARENPDRKIAIITGLNLPML

IQAYTERMMDANATVEQVAANIIKEAKGGIKALPEELNPAEETTAAPVEA

AAPQGAIPEGTVIGDGKLKINLARLDTRLLHGQVVTNWVPYSKADRIIVA

SDDVAKDELRKELIKQAAPNGIKVNVVPIQKLIDASKDPRFGNTHALVLF

ETVQDALRAIEGGVPIKELNVGSMAHSTGKTMVNNVLSMDKDDVACFEKL

RDLGVEFDVRKVPNDSKKDLFELIKKANVQ

SEQ ID NO: 155

ATGGGTATCGGTATTATTATTGCCAGCCATGGTAGGTTCGCTGAAGGAAT

CCACCAATCAGGCTCTATGATTTTTGGGGACCAAGAGAAAGTTCAAGTTG

TGACTTTCATGCCAAGTGAAGGTCCTGATGATTTGTACGCTCACTTCAAC

AACGCCATTGCACAATTCGATGTTGATGATGAAATTCTTGTTTTGGCTGA

CCTTTGGAGTGGTTCACCATTTAACCAAGCTAGTCGAATCGCTAGGGAAA

ATCCAGATCGCAAGATTGCTATCATCACAGGACTTAACTTGCCAATGCTA

ATCCAAGCATACACTGAACGTATGATGGATGCTAACGCTACTGTAGAGCA

AGTTGCTGCTAATATCATCAAGGAAGCTAAGGGTGGTATCAAGGCACTTC

CAGAAGAGCTAAATCCAGCTGAGGAAACAACTGCAGCTCCTGTAGAAGCT

GCAGCACCTCAAGGAGCTATCCCTGAAGGAACAGTCATCGGAGATGGTAA

ACTCAAGATTAACTTGGCACGTTTGGACACACGTCTCTTGCATGGTCAAG

TAGTAACTAACTGGGTACCTTATTCTAAAGCAGACCGTATTATTGTTGCT

TCGGATGACGTTGCCAAAGATGAGCTTCGTAAGGAATTGATCAAACAGGC

TGCACCAAACGGTATTAAAGTAAACGTTGTTCCGATTCAAAAATTAATTG

ATGCTTCTAAAGACCCACGTTTTGGAAATACACATGCGCTTGTCTTGTTC

GAAACTGTTCAAGACGCACTTCGTGCTATCGAAGGTGGCGTGCCAATAAA

AGAACTTAACGTTGGTTCTATGGCTCACTCAACTGGTAAAACAATGGTTA

ACAACGTTTTGTCTATGGATAAAGATGATGTTGCTTGTTTTGAAAAATTA

CGTGACCTTGGCGTTTAATTTGACGTCCGTAAGGTTCCAAACGATTCTAA

GAAAGATTTGTTTGAGCTTATCAAGAAAGCTAACGTTCAATAA

SEQ ID NO: 156

MGIGIIIASHGRFAEGIHQSGSMIFGDQEKVQVVTFMPSEGPDDLYAHEN

NAIAQFDVDDEILVLADLWSGSPFNQASRIARENPDRKIAIITGLNLPML

IQAYTERMMDANATVEQVAANIIKEAKGGIKALPEELNPAEETTAAPVEA

AAPQGAIPEGTVIGDGKLKINLARLDTRLLHGQVVTNWVPYSKADRIIVA

SDDVAKDELRKELIKQAAPNGIKVNVVPIQKLIDASKDPREGNTHALVLF

ETVQDALRAIEGGVPIKELNVGSMAHSTGKTMVNNVLSMDKDDVACFEKL

RDLGV

SEQ ID NO: 174

MSDMSIISAILVVAVAFLAGLESILDQFQFHQPLVACTLIGAATGNLTAG

IMLGGSLQMITLAWANIGAAVAPDVALASVAAAIILVKGGKFTAEGIGVA

IAIAILLAVAGLFLTMPVRTASIAFVHAADKAAEHGNIAGVERAYYLALL

LQGLRIAVPAALLLAIPAQSVQHALGLMPDWLTHGLVVGGGMVVAVGYAM

IINMMATREVWPFFAIGFALAAISQLTLIALSTIGVAIAFTYLNLSKQGG

GNGGGNGGGTSSGSGDPIGDILEDY

SEQ ID NO: 201

ATGTCAGATATGTCAATTATTTCTGCGATTTTGGTCGTAGCTGTTGCCTT

CCTTGCTGGTCTTGAAAGTATCCTTGACCAATTCCAATTCCACCAACCAC

-continued
```
TTGTTGCATGTACCCTCATCGGTGCTGCCACAGGTAACCTCACTGCAGGT

ATCATGCTTGGTGGTTCTCTTCAAATGATTACCCTTGCTTGGGCAAACAT

CGGTGCTGCCGTAGCTCCTGACGTTGCCCTTGCATCTGTTGCCGCTGCCA

TCATTTTGGTTAAAGGTGGTAAATTTACAGCTGAAGGTATCGGTGTTGCG

ATTGCAATAGCTATCCTGCTTGCAGTTGCAGGTCTCTTCCTAACTATGCC

TGTTCGTACAGCATCTATTGCCTTTGTTCATGCTGCAGATAAAGCTGCAG

AACACGGAAACATCGCTGGTGTTGAACGTGCATACTACCTCGCTCTCCTT

CTTCAAGGTTTGCGTATTGCTGTGCCAGCAGCCCTTCTTCTTGCCATCCC

GGCCCAATCTGTTCAACATGCCCTTGGCTTGATGCCTGACTGGCTCACCC

ATGGTTTGGTTGTCGGTGGTGGTATGGTCGTAGCCGTTGGTTACGCCATG

ATTATCAATATGATGGCTACTCGTTAAGTTTGGCCATTCTTCGCCATTGG

TTTTGCTTTGGCAGCAATTAGCCAATTGACACTTATCGCTCTTAGTACCA

TTGGTGTTGCCATCGCCTTCATCTACCTCAACCTTTCTAAACAAGGTGGC

GGAAATGGTGGCGGAAATGGTGGCGGAACTTCATCTGGTTCAGGCGACCC

AATCGGCGATATCTTGGAAGACTACTAG
```

SEQ ID NO: 202
```
MSDMSIISAILVVAVAFLAGLESILDQFQFHQPLVACTLIGAATGNLTAG

IMLGGSLQMITLAWANIGAAVAPDVALASVAAAIILVKGGKFTAEGIGVA

IAIAILLAVAGLFLTMPVRTASIAFVHAADKAAEHGNIAGVERAYYLALL

LQGLRIAVPAALLLAIPAQSVQHALGLMPDWLTHGLVVGGGMVVAVGYAM

IINMMATR
```

SEQ ID NO: 211
```
MAEKIQLSQADRKKVWWRSQFLQGAWNYERMQNLGWAYSLIPAIKKLYTN

KEDQAAALKRHLEFFNTHPYVAAPIIGVTLALEEEKANGTEIEDAAIQGV

KIGMMGPLAGIGDPVFWFTIRPILGALGASLAQAGNIAGPLIFFIGWNLI

RMAFLWYTQELGYKAGSEITKDISGGILKDITKGASILGMFILAVLVERW

VSVVETVKLPGKVLPKGAYIEWPKGYVTGDQLKTILGQVNDKLSFDKIQV

DTLQKQLDSLIPGLTGLLLTFACMWLLKKKVSPITIIIGLFVVGIVASFF

GIM
```

SEQ ID NO: 250
```
ATGGCTGAAAAAATTCAATTATCTCAAGCGGATCGTAAAAAAGGTTTGGT

GGCGCTCACAATTCTTGCAAGGTGCATGGAACTATGAACGTATGCAAAAC

TTGGGTTGGGCTTACTCACTCATTCCTGCTATCAAAAAACTTTATACTAA

CAAAGAGGACCAAGCCGCAGCTCTTAAACGTCACTTGGAATTCTTCAACA

CTCACCCTTACGTAGCTGCTCCTATCATAGGGGTTACCTTAGCTCTTGAA

GAAGAAAAGCTAATGGTACTGAAATCGAAGATGCGGCTATCCAAGGGGT

TAAAATCGGTATGATGGGTCCACTTGCCGGTATCGGTGACCCTGTCTTCT

GGTTCACAATTCGTCCAATTCTTGGTGCCCTTGGTGCATCATTGGCACAA

GCTGGTAACATTGCTGGTCCACTTATCTTCTTCATTGGTTGGAACCTTAT

CCGCATGGCCTTCTTGTGGTACACTCAAGAACTTGGTTACAAAGCAGGTT

CAGAAATCACTAAAGACATATCTGGTGGTATCTTGAAAGATATTACTAAA

GGGGCATCAATACTTGGTATGTTCATCTTGGCCGTCCTCGTTGAACGTTG

GGTATCTGTCGTCTTCACTGTAAAGCTTCCAGGTAAAGTTTTGCCTAAAG

GTGCTTATATTGAATGGCCAAAAGGATATGTTACTGGTGACCAACTAAAA

ACTATCCTTGGTCAAGTCAACGATAAGCTTAGCTTTGATAAGATTCAAGT

CGATACCCTACAAAAACAATTGGATTCATTAATTCCAGGTTTGACGGGAC

TTCTCCTTACTTTTGCATGTATGTGGTTGCTTAAGAAGAAAGTTTCACCA

ATCACAATCATCATCGGACTCTTTGTAGTTGGTATTGTTGCAAGCTTCTT

CGGAATCATGTAA
```

SEQ ID NO: 251
MAEKIQLSQADRKKGLVALTILARCMEL

Strains

DGCC numbers are internal references to DuPont Danisco collection; DSM numbers are the numbers assigned by the Leibniz-Institut DSMZ-Deutsche Sammlung von Mikroorganismen und Zellkulturen, GmbH (Inhoffenstr. 7B, D-38124 Braunschweig), following deposit under the Budapest Treaty.

As far as the *Streptococcus thermophilus* strain DGCC7710 deposited under the Budapest Treaty at the Leibniz-Institut DSMZ-Deutsche Sammlung von Mikroorganismen und Zellkulturen, GmbH, on Jan. 14, 2014 under number DSM28255 is concerned, we hereby confirm that the depositor, Danisco Deutschland GmbH (of Busch-Johannsen-Strasse 1, D-25899 Niebüll, Germany) has authorised the Applicant (DuPont Nutrition Biosciences ApS) to refer to the deposited biological material in this application. The expressions "DGCC7710 strain" and "DGCC7710 derivative" are used interchangeably with the expressions "DSM28255 strain" and "DSM28255 derivative".

The *Streptococcus thermophilus* strain deposited under the Budapest Treaty at the Leibniz-Institut DSMZ-Deutsche Sammlung von Mikroorganismen und Zellkulturen, GmbH, on Aug. 15, 2017 under number DSM32587 has been deposited by DuPont Nutrition Biosciences ApS.

The applicant requests that a sample of the deposited micro-organisms stated herein may only be made available to an expert, until the date on which the patent is granted.

In respect to those designations in which a European Patent is sought, a sample of these deposited microorganisms will be made available until the publication of the mention of the grant of the European patent or until the date on which application has been refused or withdrawn or is deemed to be withdrawn, only by the issue of such a sample to an expert nominated by the person requesting the sample, and approved either i) by the Applicant and/or ii) by the European Patent Office, whichever applies.

REFERENCES

Pool et al.; 2006. Metabolic Engineering 8(5): 456-464
Porter et al.; 1982. Biochim Biophys Acta 709: 178-186
Sørensen et al.; 2016. Appl Environ Microbiol 82(12): 3683-3692
Van den Bogaard et al. 2000. Journal of Bacteriology; 182: 5982-5989

SEQUENCE LISTING (266 sequences)

SEQ ID NO: 1 - DNA, 969 bp, Streptococcus thermophilus
atgagtaagaaactcttaggtattgaccttggtggaacaactgttaagtttggtattttgactgcagatggtgaagttcaagaaaaatgggctattgaaacaaatacgtttgaaaatggtagccacattgttcctgacattgtagaatctttgaaacaccgtttggaattgtatggacttactgctgaagattttattggaattggtatgggatctccaggtgcagttgaccgagaaaataaaacagtaacgggtgcctttaacttgaactgggcagaaactcaagaagttggctctgttattgaaaaagaacttggtattccattcgctattgataatgatgctaatgtggctgcactgggtgaacgttgggttggtgctggtgctaacaatcggaatgttgtctttataacattgggtacaggtgttggtggcggtgttatcgctgatggtaacttaattcatggtgttgccggtgctggtggggaaattggtcacattattgttgaacctgacacaggatttgagtgtacttgcggaaacaaggggtgtctggaaactgtagcttcagcaacaggtattgtacgtgtagcacatcatttggcagaaaaatacgaaggaaactcttctattaaagctgctgtagacaatggtgagtttgtgacaagtaaagatattatcgtagctgctactgaaggtgataagtttgctgacagcattgttgataaagtctctaaatacctcggacttgcaacagcaaacatctcaaacattcttaacccagattctgtcgttatcggtggtggtgtttctgccgcaggagaattcttgcgtagtcgtgttgaaggatactttacacgttatgcattcccacaagttcgccgtacaacaaaagtgaaattagcggagcttggaaatgatgcaggaatcattggagctgctagtcttgcttatagtattgacaaataa

SEQ ID NO: 2 - protein, 322 aa, Streptococcus thermophilus
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVGGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 3 - DNA, 969 bp, Streptococcus thermophilus
atgagtaagaaactcttaggtattgaccttggtggaacaactgttaagtttggtattttgactgcagatggtgaagttcaagaaaaatgggctattgaaacaaatacgtttgaaaatggtagccacattgttcctgacattgtagaatctttgaaacaccgtttggaattgtatggacttactgctgaagattttattggaattggtatgggatctccaggtgcagttgaccgagaaaataaaacagtaacgggtgcctttaacttgaactgggcagaaactcaagaagttggctctgttattgaaaaagaacttggtattccattcgctattgataatgatgctaatgtggctgcactgggtgaacgttgggttggtgctggtgctaacaatcggaatgttgtctttgtaacattgggtacaggtgttggtggcggtgttatcgctgatggtaacttaattcatggtgttgccggtgctggtggggaaattggtcacattattgttgaacctgacacaggatttgagtgtacttgcggaaacaaggggtgtctggaaactgtagcttcagcaacaggtattgtacgtgtagcacatcatttggcagaaaaatacgaaggaaactcttctattaaagctgctgtagacaatggtgagtttgtgacaagtaaagatattatcgtagctgctactgaaggtgataagtttgctgacagcattgttgataaagtctctaaatacctcggacttgcaacagcaaacatctcaaacattcttaacccagattctgtcgttatcggtggtggtgtttctgccgcaggagaattcttgcgtagtcgtgttgaaggatactttacacgttatgcattcccacaagttcgccgtacaacaaaagtgaaattagcggagcttggaaatgatgcaggaatcattggagctgctagtcttgcttatagtattgacaaataa

SEQ ID NO: 4 - protein, 322 aa, Streptococcus thermophilus
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVGGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 5 - DNA, 969 bp, Streptococcus thermophilus
atgagtaagaaactcttaggtattgaccttggtggaacaactgttaagtttggtattttgaatgcagatggtgaagttcaagaaaaatgggctattggaacaaatacgtttgaaaatggtagccacattgttcctgacattgtagaatctttgaaacaccgtttggaattgtatggacttactgctgaagattttattggaattggtatgggatctccaggtgcagttgaccgagaaaataaaacagtaacgggtgcctttaacttgaactgggcagaaactcaagaagttggctctgttattgaaaaagaacttggtattccattcgctattgataatgatgctaatgtggctgcactgggtgaacgttgggttggtgctggtgctaacaatcggaatgttgtctttgtaacattgggtacaggtgttggtggcggtgtcatcgttgatggtaaattaattcatggtgttgccggtgctggtggggaaattggtcacattattgttgaacctgacacaggatttgagtgtacttgcggaaacaaggggtgtctggaaactgtagcttcagcaacaggtattgtacgtatagcacatcatttggcagaaaaatacgaaggaaactcttctattaaagctgctgtagacaatggtgagtttgtgacaagtaaagatattctcgtagctgctactgaaggtgataagtttgctgacagcattgttgataaagtctctaaatacctcggacttgcaacagcaaacatctcaaacattcttaacccagattctgtcgttatcggtggtggtgtttctgccgcaggagaattcttgcgtagtcgtgttgaaggatactttacacgttatgcattcccacaagttcgccgtacaacaaaagtgaaattagcggagcttggaaatgatgcaggaatcattggagccgctagtcttgcttatagtattgacaaataa

SEQ ID NO: 6 - protein, 322 aa, Streptococcus thermophilus
MSKKLLGIDLGGTTVKFGILNADGEVQEKWAIGTNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVGGGVIVDGKLIHGVAGAGGEIGHIIVEPDTGFECTCGNKGCLETVASATGIVRIAHHLAEKYEGNSSIKAAVDNGEFVTSKDILVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 7 - DNA, 969 bp, Streptococcus thermophilus
atgagtaagaaactcttaggtattgaccttggtggaacaactgttaagtttggtattttgactgcagatggtgaagttcaagaaaaatgggctattgaaacaaatacgtttgaaaatggtagccacattgttcctgacattgtagaatctttgaaacaccgtttggaattgtatggacttactgctgaagcttttattggaattggtatgggatctccaggtgcagttgaccgagaaaataaaacagtaacgggtgcctttaacttgaactgggcagaaactcaagaagttggctctgttattgaaaaagaacttggtattccattcgctattgataatgatgctaatgtagctgcactgggtgaacgttgggttggtgctggtgctaacaatcggaatgttgtctttataacattgggtacaggtgttggtggcggtgttatcgctgatggtaacttaattcatggtgttgccggtgctggtggggaaattggtcacattattgttgaacctgacacaggatttgagtgtacttgcggaaacaaggggtgtctggaaactgtagcttcagcaacaggtattgtacgtgtagcacatcatttggcagaaaaatacgaaggaaactcttctattaaagctgctgtagacaatggtgagtttgtgacaagtaaagatattatcgtagctgctactgaaggtgataagtttgctgacagcattgttgataaagtctctaaatacctcggacttgcaacagcaaacatctcaaacattcttaacccagattctgtcgttatcggtggtggtgtttctgccgcaggagaattcttgcgtagtcgtgttgaaggatactttacacgttatgcattcccacaagttcgccgtacaacaaaagtgaaattagcggagcttggaaatgatgcaggaatcattggagctgctagtcttgcttatagtattgacaaataa

SEQ ID NO: 8 - protein, 322 aa, Streptococcus thermophilus
MSKKLLGIDLGGTTVKFGILTADGEVQEKWAIETNTFENGSHIVPDIVESLKHRLELYGLTAEAFIGIGMGSPGAVDRENKTVTGAFNLNWAETQEVGSVIEKELGIPFAIDNDANVAALGERWVGAGANNRNVVFITLGTGVGGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 9 - DNA, 969 bp, Streptococcus thermophilus
atgagtaagaaactcttaggtattgaccttggtggaacaactgttaagtttggtattttgactgcagatggtgaagttcaagaaaaatgggctattgaaacaaatacgtttgaaaatggtagccacattgttcctgacattgtagaatctttgaaacaccgtttggaattgtatggacttactgctgaagattttattggaattggtatgggatctccaggtgcagttgaccgagaaaataaaacagtaacgggtgcctttaacttgaactgggcagaaactcaagaagttggctctgttattgaaaaagaacttggtattccattcgctattgataatgatgctaatgtggctgcactgggtgaacgttgggttggtgctggtgctaacaatcggaatgttgtctttataacattgggtacaggtgttggtggcggtgttatcgctgatggtaacttaattcatggtgttgccggtgctggtggggaaattggtcacattattgttgaacctgacacaggatttgagtgtacttgcggaaacaaggggtgtctggaaactgcagcttcagcaacaggtattgtacgtgtagcacatcatttggcagaaaaatacgaaggaaactcttctattaaagctgctgtagacaatggtgagtttgtgacaagtaaagatattatcgtagctgctactgaaggtgataagtttgctgacagcattgttgataaagtctctaaatacctcggacttgcaacagcaaacatctcaaacattcttaacccagattctgtcgttatcggtggtggtgtttctgccgcaggagaattcttgcgtagtcgtgttgaaggatactttacacgttatgcattcccacaagttcgccgtacaacaaaagtgaaattagcggagcttggaaatgatgcaggaatcattggagctgctagtcttgcttatagtattgacaaataa

SEQ ID NO: 10 - protein, 322 aa, Streptococcus thermophilus
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVGGGVIADGNLIHGVAGAGGEIGHIIVEPDTGFECTCGNKGCLETAASATGIVRVAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 11 - DNA, 969 bp, Streptococcus thermophilus
atgagtaagaaactcttaggtattgaccttggtggaacaactgttaagtttggtattttgactgcagatggtgaagttcaagaaaaatgggctattgaaacaaatacgtttgaaaatggtagccacattgttcctgacattgtagaatctttgaaacaccgtttggaattgtatggacttactgctgaagattttattggaattggtatgggatctccaggtgcagttgaccgagaaaataaaacagtaacgggtgcctttaacttgaactgggcagaaactcaagaagttggctctgttattgaaaaagaacttggtattccattcgctattgataatgatgctaatgtagctgcactgggtgaacgttgggttggtgctggtgctaacaatcggaatgttgtctttataacattgggtacaggtgttggtggcggtgttatcgctgatggtaacttaattcatggtgttgccggtgctggtggggaaattggtcacattattgttgaacctgacacaggatttgagtgtacttgcggaaacaatgggtgtctggaaactgtagcttcagcaacaggtattgtacgtgtaacacatcatttggcagaaaaatacgaaggaaactcttctattaaagctgctgtagacaatggtgagtttgtgacaagtaaagatattatcgtagctgctactgaaggtgataagtttgctgacagcattgttgataaagtctctaaatacctcggacttgcaacagcaaacatctcaaacattcttaacccagattctgtcgttatcggtggtggtgtttctgccgcaggagaattcttgcgtagtcgtgttgaaggatactttacacgttatgcattcccacaagttcgccgtacaacaaaagtgaaattagcggagcttggaaatgatgcaggaatcattggagctgctagtcttgcttatagtattgacaaataa

SEQ ID NO: 12 - protein, 322 aa, Streptococcus thermophilus
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVGGGVIADGNLIHGVAGAGGEIGHIIVEPDTGFECTCGNNGCLETVASATGIVRVTHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 13 - DNA, 969 bp, Streptococcus thermophilus
atgagtaagaaactcttaggtattgaccttggtggaacaactgttaagtttggtattttgactgcagatggtgaagttcaagaaaaatgggctattgaaacaaatacgtttgaaaatggtagccacattgttcctgacattgtagactctttgaaacaccgtttggaattgtatggacttactgctgaagattttattggaattggtatgggatctccaggtgcagttgaccgagaaaataaaacagtaacgggtgcctttaacttgaactgggcagaaactcaagaagttggctctgttattgaaaaagaacttggtattccattcgctattgataatgatgctaatgtggctgcactgggtgaacgttgggttggtgctggtgctaacaatcggaatgttgtctttgtaacattgggtacaggtgttggtggcggtgttatcgctgatggtaacttaattcatggtgttgccggtgctggtggggaaattggtcacattattgttgaacctgacacaggatttgagtgtacttgcggaaacaaggggtgtctggaaactgtagcttcagcaacaggtattgtacgtgtagcacatcatttggcagaaaaatacgaaggaaactcttctattaaagctgctgtagacaatggtgagcttgtgacaagtaaagatattctcgtagctgctactgaaggtgataagtttgctgacagcattgttgataaagtctctaaatacctcggacttgcaatagcaaacatctcaaacattcttaacccagattctgtcgttatcggtggtggtgtttctgccgcaggagaattcttgcgtagtcgtgttgaaggatactttacacgttatgcattcccacaagttcgccgtacaacaaaagtgaaattagcggagcttggaaatgatgcaggaatcattggagctgctagtcttgcttatagtattgacaaataa

SEQ ID NO: 14 - protein, 322 aa, Streptococcus thermophilus
MSKKLLGIDLGGTTVKFGILTADGEVQEKWAIETNTFENGSHIVPDIVDSLKHRLELYGLTAEDFIGIGMGSPGAVDRENKTVTGAFNLNWAETQEVGSVIEKELGIPFAIDNDANVAALGERWVGAGANNRNVVFVTLGTGVGGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVVIGGGVSAAGEFLRSRVEGYFTRYAFPQVRRTTKVKLAELGNDAGIIGAASLAYSIDK

SEQ ID NO: 15 - DNA, 969 bp, Streptococcus thermophilus
atgagtaagaaactcttaggtattgaccttggtggaacaactgttaagtttggtattttgaatgcagatggtgaagttcaagaaaaatgggctattggaacaaatacgtttgaaaatggtagccacattgttcctgacattgtagaatctttgaaacaccgtttggaattgtatggacttactgctgaagattttattggaattggtatgggatctccaggtgcagttgaccgagaaaataaaacagtaacgggtgcctttaacttgaactgggcagaaactcaagaagttggctctgttattgaaaaagaacttggtattccattcgctattgataatgatgctaatgtggctgcactgggtgaacgttgggttggtgctggtgctaacaatcggaatgttgtctttgtaacattgggtacaggtgttggtggcggtgtcatcgttgatggtaaattaattcatggtgttgccggtgctggtggggaaattggtcacattattgttgaacctgacacaggatttgagtgtacttgcggaaacaaggggtgtctggaaactgtagcttcagcaacaggtattgtacgtatagcacatcatttggcagaaaaatacgaaggaaactcttctattaaagctgctgtagacaatggtgagtttgtgacaagtaaagatattatcgtagctgctactgaaggtgataagtttgctgacagcattgttgataaagtctctaaatacctcggacttgcaacagcaaacatctcaaacattcttaacccagattctgtcgttatcggtggtggtgtttctgccgcaggagaattcttgcgtagtcgtgttgaaggatactttacacgttatgcattcccacaagttcgccgtacaacaaaagtgaaattagcggagcttggaaatgatgcaggaatcattggagctgctagtcttgcttatagtattgacaaataa

SEQ ID NO: 16 - protein, 322 aa, Streptococcus thermophilus
MSKKLLGIDLGGTTVKFGILNADGEVQEKWAIGTNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVGGGVIVDGKLIHGVAGAGGEIGHIIVEPDTGFECTCGNKGCLETVASATGIVRIAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 17 - DNA, 969 bp, Streptococcus thermophilus
atgagtaagaaactcttaggtattgaccttggtggaacaactgttaagtttggtattttgactgcagatggtgaagttcaagaaaaatgggctattgaaacaaatacgtttgataatggtagccacattgttcctgacattgtagaatctttgaaacaccgtttggaattgtatggacttactgctgaagattttattggaattggtatgggatctccaggtgcagttgaccgagaaaataaaacagtaacgggtgcctttaacttgaactgggcagaaactcaagaagttggttctgttattgaaaaagaacttggtattccattcgctattgataatgatgctaatgtggctgcactgggtgaacgttgggttggtgctggtgctaacagtcgggatgttgtctttgtaacattgggtacaggtgttggtggcggtgttatcgctgatggtaacttaattcatggtgttgccggtgctggtggggaaattggtcacattattgttgaacctgacacaggatttgagtgtacttgcggaaacaaggggtgtctggaaactgtagcttcagcaacaggtattgtacgtgtagcacatcatttggcagaaaaatacgaaggaaactcttctattaaagctgctgtagacaatggtgagcttgtgacaagtaaagatattctcgtagctgctactgaaggtgataagtttgctgacagcattgttgataaagtctctaaatacctcggacttgcaatagcaaacatctcaaacattcttaacccagattctgttgttatcggtggtggtgtttctgccgcaggagaattcttgcgtagtcgtgttgaaggatactttacacgttatgcattcccacaagttcgccgtacaacaaaagtgaaattagcggagcttggaaatgatgcaggaatcattggagctgctagtcttgcttatagtattgacaaataa

SEQ ID NO: 18 - protein, 322 aa, Streptococcus thermophilus
MSKKLLGIDLGGTTVKFGILTADGEVQEKWAIETNTFDNGSHIVPDIVESLKHRLELYGLTAEDFIGIGMGSPGAVDRENKTVTGAFNLNWAETQEVGSVIEKELGIPFAIDNDANVAALGERWVGAGANSRDVVFVTLGTGVGGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVVIGGGVSAAGEFLRSRVEGYFTRYAFPQVRRTTKVKLAELGNDAGIIGAASLAYSIDK

SEQ ID NO: 19 - DNA, 969 bp, Streptococcus thermophilus
atgagtaagaaactcttaggtattgaccttggtggaacaactgttaagtttggtattttgactgcagatggtgaagttcaagaaaaatgggctattgaaacaaatacgtttgataatggtagccacattgttcctgacattgtagaatctttgaaacaccgtttggaattgtatggacttactgctgaagattttattggaattggtatgggatctccaggtgcagttgaccgagaaaataaaacagtaacgggtgcctttaacttgaactgggcagaaactcaagaagttggctctattattgaaaaagaacttggtattccattcgctattgataatgatgctaatgtggctgcactgggtgaacgttgggttggtgctggtgctaacaatcgggatgttgtctttgtaacattgggtacaggtgttggtggcggtgttatcgctgatggtaacttaattcatggtgttgccggtgctggtggggaaattggtcacattattgttgaacctgacacaggatttgagtgtacttgcggaaacaaggggtgtctggaaactgtagcttcagcaacaggtattgtacgtgtagcacatcatttggcagaaaaatacgaaggaaactcttctattaaagctgctgtagacaatggtgagcttgtgacaagtaaagatattctcgtagctgctactgaaggtgataagtttgctgacagcattgttgataaagtctctaaatacctcggacttgcaatagcaaacatctcaaacattcttaacccagattctgtcattatcggtggtggtgtttctgccgcaggagaattcttgcgtagtcgtgttgaaggatactttacacgttatgcattcccacaagttcgccgtacaacaaaagtgaaattagcggagcttggaaatgatgcaggaatcattggagctgctagtcttgcttatagtattgacaaataa

SEQ ID NO: 20 - protein, 322 aa, Streptococcus thermophilus
MSKKLLGIDLGGTTVKFGILTADGEVQEKWAIETNTFDNGSHIVPDIVESLKHRLELYGLTAEDFIGIGMGSPGAVDRENKTVTGAFNLNWAETQEVGSIIEKELGIPFAIDNDANVAALGERWVGAGANNRDVVFVTLGTGVGGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVIIGGGVSAAGEFLRSRVEGYFTRYAFPQVRRTTKVKLAELGNDAGIIGAASLAYSIDK

SEQ ID NO: 21 - DNA, 969 bp, Streptococcus thermophilus
atgagtaagaaactcttaggtattgaccttggtggaacaactgttaagtttggtattttgactgcagatggtgaagttcaagaaaaatgggctattgaaacaaatacgtttgaaaatggtagccacattgttcctgacattgtagaatctttgaaacaccgtttggaattgtatggacttactgctgaagattttattggaattggtatgggatctccaggtgcagttgaccgagaaaataaaacagtaacgggtgcctttaacttgaactgggcagaaactcaagaagttggctctgttattgaaaaagaacttggtattccattcgctattgataatgatgctaatgtggctgcactgggtgaacgttgggttggtgctggtgctaacaatcggaatgttgtctttataacattgggtacaggtgttggtggcggtgttatcgctgatggtaacttaattcatggtgttgccggtgctggtggggaaattggtcacattattgttgaacctgacacaggatttgagtgtacttgcggaaacaaggggtgtctggaaactgtagcttcagcaacaggtattgtacgtgtagcacatcatttggcagaaaaatacgaaggaaactcttctattaaagctgctgtagacaatggtgagtttgtgacaagtaaagatattatcgtagctgctactgaaggtgataagtttgctgacagcattgttgataaagtctctaaatacctcggacttgcaacagcaaacatctcaaacattcttaacccagattctgtcgttatcggtggtggtgtttctgccgcaggaaaattcttgcgtagtcgtgttgaaggatactttacacgttatgcattcccacaagttcgccgtacaacaaaagtgaaattagcggagcttggaaatgatgcaggaatcattggagctgctagtcttgcttatagtattgacaaataa

SEQ ID NO: 22 - protein, 322 aa, Streptococcus thermophilus
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVGGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGKFLRSRVEGYFTRYAFPQVRRTTKVKLAELGNDAGIIGAASLAYSIDK

SEQ ID NO: 23 - protein, 322 aa, Streptococcus thermophilus
MSKKLLGIDLGGTTVKFGILTADGEVQEKWAIETNTFENGSHIVPDIVESLKHRLELYGLTAEDFIGIGMGPPGAVDRENKTVTGAFNLNWAETQEVGSVIEKELGIPFAIDNDANVAALGERWVGAGANNRNVVFITLGTGVGGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 24 - DNA, 147 bp, Streptococcus thermophilus
catagtatcctcctcatatttcagtataacataacttttattttttacctatattttactaaaaaaatagtaaaaatattgattttccatgtgaaaggggttatgatttcagtataaacaaaaagaataagtgagatacatcctatg

SEQ ID NO: 25 - protein, 322 aa, Streptococcus thermophilus
  MISC_FEATURE (275)..(275): Xaa can be any naturally occurring amino acid, but not Glu
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVGGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGXFLRSRVEGYFTRYAFPQVRRTTKVKLAELGNDAGIIGAASLAYSIDK

SEQ ID NO: 26 - protein, 322 aa, Streptococcus thermophilus
  MISC_FEATURE (275)..(275): Xaa can be any naturally occurring amino acid, but not Glu
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVGGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGXFLRSRVEGYFTRYAFPQVRRTTKVKLAELGNDAGIIGAASLAYSIDK

SEQ ID NO: 27 - protein, 322 aa, Streptococcus thermophilus
  MISC_FEATURE (275)..(275): Xaa can be any naturally occurring amino acid, but not Glu
MSKKLLGIDLGGTTVKFGILNADGEVQEKWAIGTNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVGGGVIVDGKLIHGVAGAGGEIGHIIVEPDTGFECTCGNKGCLETVASATGIVRIAHHLAEKYEGNSSIKAAVDNGEFVTSKDILVAATEGDKFADSIVDKVSKYLGLATANISNILNPDSVVIGGGVSAAGXFLRSRVEGYFTRYAFPQVRRTTKVKLAELGNDAGIIGAASLAYSIDK

SEQ ID NO: 28 - protein, 322 aa, Streptococcus thermophilus
  MISC_FEATURE (275)..(275): Xaa can be any naturally occurring amino acid, but not Glu
MSKKLLGIDLGGTTVKFGILTADGEVQEKWAIETNTFENGSHIVPDIVESLKHRLELYGLTAEAFIGIGMGSPGAVDRENKTVTGAFNLNWAETQEVGSVIEKELGIPFAIDNDANVAALGERWVGAGANNRNVVFITLGTGVGGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGXFLRSRVEGYFTRYAFPQVRRTTKVKLAELGNDAGIIGAASLAYSIDK

SEQ ID NO: 29 - protein, 322 aa, Streptococcus thermophilus
  MISC_FEATURE (275)..(275): Xaa can be any naturally occurring amino acid, but not Glu
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVGGGVIADGNLIHGVAGAGGEIGHIIVEPDTGFECTCGNKGCLETAASATGIVRVAHHLAEKYEGNSSIKAAVDNGEFVTSKDIIVAATEGDKFADSIVDKVSKYLGLATANISNILNPDSVVIGGGVSAAGXFLRSRVEGYFTRYAFPQVRRTTKVKLAELGNDAGIIGAASLAYSIDK

SEQ ID NO: 30 - protein, 322 aa, Streptococcus thermophilus
  MISC_FEATURE (275)..(275): Xaa can be any naturally occurring amino acid, but not Glu
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVGGGVIADGNLIHGVAGAGGEIGHIIVEPDTGFECTCGNNGCLETVASATGIVRVTHHLAEKYEGNSSIKAAVDNGEFVTSKDIIVAATEGDKFADSIVDKVSKYLGLATANISNILNPDSVVIGGGVSAAGXFLRSRVEGYFTRYAFPQVRRTTKVKLAELGNDAGIIGAASLAYSIDK

SEQ ID NO: 31 - protein, 322 aa, Streptococcus thermophilus
  MISC_FEATURE (275)..(275): Xaa can be any naturally occurring amino acid, but not Glu
MSKKLLGIDLGGTTVKFGILTADGEVQEKWAIETNTFENGSHIVPDIVDSLKHRLELYGLTAEDFIGIGMGSPGAVDRENKTVTGAFNLNWAETQEVGSVIEKELGIPFAIDNDANVAALGERWVGAGANNRNVVFVTLGTGVGGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVVIGGGVSAAGXFLRSRVEGYFTRYAFPQVRRTTKVKLAELGNDAGIIGAASLAYSIDK

SEQ ID NO: 32 - protein, 322 aa, Streptococcus thermophilus
  MISC_FEATURE (275)..(275): Xaa can be any naturally occurring amino acid, but not Glu
MSKKLLGIDLGGTTVKFGILNADGEVQEKWAIGTNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVGGGVIVDGKLIHGVAGAGGEIGHIIVEPDTGFECTCGNKGCLETVASATGIVRIAHHLAEKYEGNSSIKAAVDNGEFVTSKDIIVAATEGDKFADSIVDKVSKYLGLATANISNILNPDSVVIGGGVSAAGXFLRSRVEGYFTRYAFPQVRRTTKVKLAELGNDAGIIGAASLAYSIDK

SEQ ID NO: 33 - protein, 322 aa, Streptococcus thermophilus
  MISC_FEATURE (275)..(275): Xaa can be any naturally occurring amino acid, but not Glu
MSKKLLGIDLGGTTVKFGILTADGEVQEKWAIETNTFDNGSHIVPDIVESLKHRLELYGLTAEDFIGIGMGSPGAVDRENKTVTGAFNLNWAETQEVGSVIEKELGIPFAIDNDANVAALGERWVGAGANSRDVVFVTLGTGVGGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVVIGGGVSAAGXFLRSRVEGYFTRYAFPQVRRTTKVKLAELGNDAGIIGAASLAYSIDK

SEQ ID NO: 34 - protein, 322 aa, Streptococcus thermophilus
  MISC_FEATURE (275)..(275): Xaa can be any naturally occurring amino acid, but not Glu
MSKKLLGIDLGGTTVKFGILTADGEVQEKWAIETNTFDNGSHIVPDIVESLKHRLELYGLTAEDFIGIGMGSPGAVDRENKTVTGAFNLNWAETQEVGSIIEKELGIPFAIDNDANVAALGERWVGAGANNRDVVFVTLGTGVGGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVIIGGGVSAAGXFLRSRVEGYFTRYAFPQVRRTTKVKLAELGNDAGIIGAASLAYSIDK

SEQ ID NO: 35 - protein, 322 aa, Streptococcus thermophilus
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVGGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGKFLRSRVEGYFTRYAFPQVRRTTKVKLAELGNDAGIIGAASLAYSIDK

SEQ ID NO: 36 - protein, 322 aa, Streptococcus thermophilus
MSKKLLGIDLGGTTVKFGILNADGEVQEKWAIGTNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVGGGVIVDGKLIHGVAGAGGEIGHIIVEPDTGFECTCGNKGCLETVASATGIVRIAHHLAEKYEGNSSIKAAVDNGEFVTSKDILVAATEGDKFADSIVDKVSKYLGLATANISNILNPDSVVIGGGVSAAGKFLRSRVEGYFTRYAFPQVRRTTKVKLAELGNDAGIIGAASLAYSIDK

SEQ ID NO: 37 - protein, 322 aa, Streptococcus thermophilus
MSKKLLGIDLGGTTVKFGILTADGEVQEKWAIETNTFENGSHIVPDIVESLKHRLELYGLTAEAFIGIGMGSPGAVDRENKTVTGAFNLNWAETQEVGSVIEKELGIPFAIDNDANVAALGERWVGAGANNRNVVFITLGTGVGGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGKFLRSRVEGYFTRYAFPQVRRTTKVKLAELGNDAGIIGAASLAYSIDK

SEQ ID NO: 38 - protein, 322 aa, Streptococcus thermophilus
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVGGGVIADGNLIHGVAGAGGEIGHIIVEPDTGFECTCGNKGCLETAASATGIVRVAHHLAEKYEGNSSIKAAVDNGEFVTSKDIIVAATEGDKFADSIVDKVSKYLGLATANISNILNPDSVVIGGGVSAAGKFLRSRVEGYFTRYAFPQVRRTTKVKLAELGNDAGIIGAASLAYSIDK

SEQ ID NO: 39 - protein, 322 aa, Streptococcus thermophilus
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVGGGVIADGNLIHGVAGAGGEIGHIIVEPDTGFECTCGNNGCLETVASATGIVRVTHHLAEKYEGNSSIKAAVDNGEFVTSKDIIVAATEGDKFADSIVDKVSKYLGLATANISNILNPDSVVIGGGVSAAGKFLRSRVEGYFTRYAFPQVRRTTKVKLAELGNDAGIIGAASLAYSIDK

SEQ ID NO: 40 - protein, 322 aa, Streptococcus thermophilus
MSKKLLGIDLGGTTVKFGILTADGEVQEKWAIETNTFENGSHIVPDIVDSLKHRLELYGLTAEDFIGIGMGSPGAVDRENKTVTGAFNLNWAETQEVGSVIEKELGIPFAIDNDANVAALGERWVGAGANNRNVVFVTLGTGVGGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVVIGGGVSAAGKFLRSRVEGYFTRYAFPQVRRTTKVKLAELGNDAGIIGAASLAYSIDK

SEQ ID NO: 41 - protein, 322 aa, Streptococcus thermophilus
MSKKLLGIDLGGTTVKFGILNADGEVQEKWAIGTNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVGGGVIVDGKLIHGVAGAGGEIGHIIVEPDTGFECTCGNKGCLETVASATGIVRIAHHLAEKYEGNSSIKAAVDNGEFVTSKDIIVAATEGDKFADSIVDKVSKYLGLATANISNILNPDSVVIGGGVSAAGKFLRSRVEGYFTRYAFPQVRRTTKVKLAELGNDAGIIGAASLAYSIDK

SEQ ID NO: 42 - protein, 322 aa, Streptococcus thermophilus
MSKKLLGIDLGGTTVKFGILTADGEVQEKWAIETNTFDNGSHIVPDIVESLKHRLELYGLTAEDFIGIGMGSPGAVDRENKTVTGAFNLNWAETQEVGSVIEKELGIPFAIDNDANVAALGERWVGAGANSRDVVFVTLGTGVGGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVVIGGGVSAAGKFLRSRVEGYFTRYAFPQVRRTTKVKLAELGNDAGIIGAASLAYSIDK

SEQ ID NO: 43 - protein, 322 aa, Streptococcus thermophilus
MSKKLLGIDLGGTTVKFGILTADGEVQEKWAIETNTFDNGSHIVPDIVESLKHRLELYGLTAEDFIGIGMGSPGAVDRENKTVTGAFNLNWAETQEVGSIIEKELGIPFAIDNDANVAALGERWVGAGANNRDVVFVTLGTGVGGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVIIGGGVSAAGKFLRSRVEGYFTRYAFPQVRRTTKVKLAELGNDAGIIGAASLAYSIDK

SEQ ID NO: 44 - DNA, 969 bp, Streptococcus thermophilus
atgagtaagaaactcttaggtattgaccttggtggaacaactgttaagtttggtattttgactgcagatggtgaagttcaagaaaaatgggctattgaaacaaatacgtttgaaaatggtagccacattgttcctgacattgtagaatctttgaaacaccgtttggaattgtatggacttactgctgaagattttattggaattggtatgggatctccaggtgcagttgaccgagaaaataaaacagtaacgggtgcctttaacttgaactgggcagaaactcaagaagttggctctgttattgaaaaagaacttggtattccattcgctattgataatgatgctaatgtggctgcactgggtgaacgttgggttggtgctggtgctaacaatcggaatgttgtctttataacattgggtacaggtgttagtggcggtgttatcgctgatggtaacttaattcatggtgttgccggtgctggtggggaaattggtcacattattgttgaacctgacacaggatttgagtgtacttgcggaaacaaggggtgtctggaaactgtagcttcagcaacaggtattgtacgtgtagcacatcatttggcagaaaaatacgaaggaaactcttctattaaagctgctgtagacaatggtgagtttgtgacaagtaaagatattatcgtagctgctactgaaggtgataagtttgctgacagcattgttgataaagtctctaaatacctcggacttgcaacagcaaacatctcaaacattcttaacccagattctgtcgttatcggtggtggtgtttctgccgcaggagaattcttgcgtagtcgtgttgaaggatactttacacgttatgcattcccacaagttcgccgtacaacaaaagtgaaattagcggagcttggaaatgatgcaggaatcattggagctgctagtcttgcttatagtattgacaaataa

SEQ ID NO: 45 - protein, 322 aa, Streptococcus thermophilus
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVSGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 46 - protein, 322 aa, Streptococcus thermophilus
  MISC_FEATURE (144)..(144): Xaa can be any naturally occurring amino acid, but not Gly
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVXGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 47 - protein, 322 aa, Streptococcus thermophilus
  MISC_FEATURE (144)..(144): Xaa can be any naturally occurring amino acid, but not Gly
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVXGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 48 - protein, 322 aa, Streptococcus thermophilus
  MISC_FEATURE (144)..(144): Xaa can be any naturally occurring amino acid, but not Gly
MSKKLLGIDLGGTTVKFGILNADGEVQEKWAIGTNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVXGGVIVDGKLIHGVAGAGGEIGHIIVEPDTGFECTCGNKGCLETVASATGIVRIAHHLAEKYEGNSSIKAAVDNGEFVTSKDILVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 49 - protein, 322 aa, Streptococcus thermophilus
  MISC_FEATURE (144)..(144): Xaa can be any naturally occurring amino acid, but not Gly
MSKKLLGIDLGGTTVKFGILTADGEVQEKWAIETNTFENGSHIVPDIVESLKHRLELYGLTAEAFIGIGMGSPGAVDRENKTVTGAFNLNWAETQEVGSVIEKELGIPFAIDNDANVAALGERWVGAGANNRNVVFITLGTGVXGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 50 - protein, 322 aa, Streptococcus thermophilus
  MISC_FEATURE (144)..(144): Xaa can be any naturally occurring amino acid, but not Gly
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVXGGVIADGNLIHGVAGAGGEIGHIIVEPDTGFECTCGNKGCLETAASATGIVRVAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 51 - protein, 322 aa, Streptococcus thermophilus
  MISC_FEATURE (144)..(144): Xaa can be any naturally occurring amino acid, but not Gly
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVXGGVIADGNLIHGVAGAGGEIGHIIVEPDTGFECTCGNNGCLETVASATGIVRVTHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 52 - protein, 322 aa, Streptococcus thermophilus
  MISC_FEATURE (144)..(144): Xaa can be any naturally occurring amino acid, but not Gly
MSKKLLGIDLGGTTVKFGILTADGEVQEKWAIETNTFENGSHIVPDIVDSLKHRLELYGLTAEDFIGIGMGSPGAVDRENKTVTGAFNLNWAETQEVGSVIEKELGIPFAIDNDANVAALGERWVGAGANNRNVVFVTLGTGVXGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVVIGGGVSAAGEFLRSRVEGYFTRYAFPQVRRTTKVKLAELGNDAGIIGAASLAYSIDK

SEQ ID NO: 53 - protein, 322 aa, Streptococcus thermophilus
  MISC_FEATURE (144)..(144): Xaa can be any naturally occurring amino acid, but not Gly
MSKKLLGIDLGGTTVKFGILNADGEVQEKWAIGTNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVXGGVIVDGKLIHGVAGAGGEIGHIIVEPDTGFECTCGNKGCLETVASATGIVRIAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 54 - protein, 322 aa, Streptococcus thermophilus
  MISC_FEATURE (144)..(144): Xaa can be any naturally occurring amino acid, but not Gly
MSKKLLGIDLGGTTVKFGILTADGEVQEKWAIETNTFDNGSHIVPDIVESLKHRLELYGLTAEDFIGIGMGSPGAVDRENKTVTGAFNLNWAETQEVGSVIEKELGIPFAIDNDANVAALGERWVGAGANSRDVVFVTLGTGVXGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVVIGGGVSAAGEFLRSRVEGYFTRYAFPQVRRTTKVKLAELGNDAGIIGAASLAYSIDK

SEQ ID NO: 55 - protein, 322 aa, Streptococcus thermophilus
  MISC_FEATURE (144)..(144): Xaa can be any naturally occurring amino acid, but not Gly
MSKKLLGIDLGGTTVKFGILTADGEVQEKWAIETNTFDNGSHIVPDIVESLKHRLELYGLTAEDFIGIGMGSPGAVDRENKTVTGAFNLNWAETQEVGSIIEKELGIPFAIDNDANVAALGERWVGAGANNRDVVFVTLGTGVXGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVIIGGGVSAAGEFLRSRVEGYFTRYAFPQVRRTTKVKLAELGNDAGIIGAASLAYSIDK

SEQ ID NO: 56 - protein, 322 aa, Streptococcus thermophilus
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVSGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 57 - protein, 322 aa, Streptococcus thermophilus
MSKKLLGIDLGGTTVKFGILNADGEVQEKWAIGTNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVSGGVIVDGKLIHGVAGAGGEIGHIIVEPDTGFECTCGNKGCLETVASATGIVRIAHHLAEKYEGNSSIKAAVDNGEFVTSKDILVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 58 - protein, 322 aa, Streptococcus thermophilus
MSKKLLGIDLGGTTVKFGILTADGEVQEKWAIETNTFENGSHIVPDIVESLKHRLELYGLTAEAFIGIGMGSPGAVDRENKTVTGAFNLNWAETQEVGSVIEKELGIPFAIDNDANVAALGERWVGAGANNRNVVFITLGTGVSGGVIADGNLIHGVAGAGGEIGHIIVEPDTGFECTCGNKGCLETVASATGIVRVAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 59 - protein, 322 aa, Streptococcus thermophilus
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVSGGVIADGNLIHGVAGAGGEIGHIIVEPDTGFECTCGNKGCLETAASATGIVRVAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 60 - protein, 322 aa, Streptococcus thermophilus
MSKKLLGIDLGGTTVKFGILTADGEVQEKWAIETNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFITLGTGVSGGVIADGNLIHGVAGAGGEIGHIIVEPDTGFECTCGNNGCLETVASATGIVRVTHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 61 - protein, 322 aa, Streptococcus thermophilus
MSKKLLGIDLGGTTVKFGILTADGEVQEKWAIETNTFENGSHIVPDIVDSLKHRLELYGLTAEDFIGIGMGSPGAVDRENKTVTGAFNLNWAETQEVGSVIEKELGIPFAIDNDANVAALGERWVGAGANNRNVVFVTLGTGVSGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVVIGGGVSAAGEFLRSRVEGYFTRYAFPQVRRTTKVKLAELGNDAGIIGAASLAYSIDK

SEQ ID NO: 62 - protein, 322 aa, Streptococcus thermophilus
MSKKLLGIDLGGTTVKFGILNADGEVQEKWAIGTNTFENGSHIVPDIVESLKHRLELYGLTAEDFIGIGMGSPGAVDRENKTVTGAFNLNWAETQEVGSVIEKELGIPFAIDNDANVAALGERWVGAGANNRNVVFVTLGTGVSGGVIVDGKLIHGVAGAGGEIGHIIVEPDTGFECTCGNKGCLETVASATGIVRIAHHLAEKYEGNSSIKAAVDNGEFVTSKDIIVAATEGDKFADSIVDKVSKYLGLATANISNILNPDSVVIGGGVSAAGEFLRSRVEGYFTRYAFPQVRRTTKVKLAELGNDAGIIGAASLAYSIDK

SEQ ID NO: 63 - protein, 322 aa, Streptococcus thermophilus
MSKKLLGIDLGGTTVKFGILTADGEVQEKWAIETNTFDNGSHIVPDIVESLKHRLELYGLTAEDFIGIGMGSPGAVDRENKTVTGAFNLNWAETQEVGSVIEKELGIPFAIDNDANVAALGERWVGAGANSRDVVFVTLGTGVSGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVVIGGGVSAAGEFLRSRVEGYFTRYAFPQVRRTTKVKLAELGNDAGIIGAASLAYSIDK

SEQ ID NO: 64 - protein, 322 aa, Streptococcus thermophilus
MSKKLLGIDLGGTTVKFGILTADGEVQEKWAIETNTFDNGSHIVPDIVESLKHRLELYGLTAEDFIGIGMGSPGAVDRENKTVTGAFNLNWAETQEVGSIIEKELGIPFAIDNDANVAALGERWVGAGANNRDVVFVTLGTGVSGGVIADGNLIHGVAGAGGEIGHIIVEPDTGFECTCGNKGCLETVASATGIVRVAHHLAEKYEGNSSIKAAVDNGELVTSKDILVAATEGDKFADSIVDKVSKYLGLAIANISNILNPDSVIIGGGVSAAGEFLRSRVEGYFTRYAFPQVRRTTKVKLAELGNDAGIIGAASLAYSIDK

SEQ ID NO: 65 - DNA, 1002 bp, Streptococcus thermophilus
atgaatactgatgaaacaatcacaatttatgatgtagcgcgtgaagctggagtatcgatggcaactgtttctcgtgttgtaaatggtaacaaaaacgtaaaagaaaacacccgaaaaaaagtgctcgaagtcattgatcgtttggattaccgtccaaatgcggttgcgcgtggcttggcaagtaaaaaaacaactactgtaggagttgtcattccaaatattgtaaatagctattttgctactctagctaaaggtattgatgacattgcaaccatgtataagtataatattgttcttgcttccagtgatgataatgaggatcatgaagttacagtcattcattctctaatttctaaacaagttgatggtattatttttatgggacaccatctgacagaaaaaatccgtgcagaattctctcgtacccgtacaccgattgttctagcaggaacagttgatctcgaacaccaattaccaagtgttaacatcgactataaagctgccgttgaggattgtgtaacgcaacttgctaaaaataatgaaaaggttgcctttgtatcaggaccactaattgatgatattaatggcaaactacgtttggccgggtataagtctggacttgaaaagaataatttgagctacaacgaaggacttgtctttgaagctaaatatagctataaagacggctttgagttagcacaacgtgtcttgaactctggtgccactgctgcctatgttggggaagatgaattggctgcaggtctcttgaatggcctctttgctgcaggcaaatcagttccagaagatttcgaaatcatcacaagcaatgattcaccggttacaagctacacacgtccaaacctttctagtataaaccatcctctctatgatttaggggcagttagcatgcgtatgttgactaaaattatgcataaggaagaacttgaagataaagacgttattcttaatcatggtctaactttacgccagtcaacaaaataa

SEQ ID NO: 66 - DNA, 1002 bp, Streptococcus thermophilus
atgaatactgatgaaacaatcacaatttatgatgtagcgcgtgaagctggagtatcgatggcaactgtttctcgtgttgtaaatggtaacaaaaacgtaaaagaaaacacccgaaaaaaagtgctcgaagtcattgatcgtttggattaccgtccaaatgcggttgcgcgtggcttggcaagtaaaaaaacaactactgtaggagttgtcattccaaatattgtaaatagctattttgctactctagctaaaggtattgatgacattgcaaccatgtataagtataatattgttcttgcttccagtgatgataatgaggatcatgaagttacagtcattcattctctaatttctaaacaagttgatggtattatttttatgggacaccatctgacagaaaaaatccgtgcagaattctctcgtacccgtacaccgattgttctagcaggaacagttgatctcgaacaccaattaccaagtgttaacatcgactataaagctgccgttgaggattgtgtaacgcaacttgctaaaaataatgaaaaggttgcctttgtatcaggaccactaattgatgatattaatggcaaactacgtttggctgggtataagtctggacttgaaaagaataatttgagctacaacgaaggacttgtctttgaagctaaatatagctataaagacggctttgatttagcacaacgtgtcttgaactctggtgccactgctgcctatgttggggaagatgaattggctgcaggtctcttgaatggcctctttgctgcaggcaaatcagttccagaagatttcgaaatcatcacaagcaatgattcaccggttacaagctacacacgtccaaacctttctagtataaaccatcctctctatgatttaggggcagttagcatgcgtatgttgactaaaattatgcataaggaagaacttgaagataaagacgttattcttaatcatggtctaactttacgccagtcaacaaaataa

SEQ ID NO: 67 - DNA, 1002 bp, Streptococcus thermophilus
atgaatactgatgaaacaatcacaatttatgatgtagcgcgtgaagctggagtatcgatggcaactgtttctcgtgttgtaaatggtaacaaaaacgtaaaagaaaacacccaaaaaaaagtgctcgaagtcattgatcgtttggattaccgtccaaatgcggttgcgcgtggcttggcaagtaaaaaaacaactactgtaggagttgtcattccaaatattgtaaatagctattttgctactctagctaaaggtattgatgacattgcaaccatgtataagtataatattgttcttgcttccagtgatgataatgaggatcatgaagttacagtcattcattctctaatttctaaacaagttgatggtattatttttatgggacaccatctgacagaaaaaatccgtgcagaattctctcgtacccgtacaccgattgttctagcaggaacagttgatctcgaacaccaattaccaagtgttaacatcgactataaagctgccgttgaggattgtgtaacgcaacttgctaaaaataatgaaaaggttgcctttgtatcaggaccactaattgatgatattaatggcaaactacgtttggctgggtataagtctggacttgaaaagaataatttgagctacaacgaaggacttgtctttgaagctaaatatagctataaagacggctttgagttagcacaacgtgtcttgaactctggtgccactgctgcctatgttggggaagatgaattggctgcaggtctcttgaatggcctctttgctgcaggcaaatcagttccagaagatttcgaaatcatcacaagcaatgattcaccggttacaagctacacacgtccaaacctttctagtataaaccatcctctctatgatttaggggcagttagcatgcgtatgttgactaaaattatgcataaggaagaacttgaagataaagacgttattcttaatcatggtctaactttacgccagtcaacaaaataa

SEQ ID NO: 68 - DNA, 1002 bp, Streptococcus thermophilus
atgaatactgatgaaacaatcacaatttatgatgtagcgcgtgaagctggagtatcgatggcaactgtttctcgtgttgtaaatggtaacaaaaacgtaaaagaaaacacccgaaaaaaagtgctcgaagtcattgatcgtttggattaccgtccaaatgcggttgcgcgtggcttggcaagtaaaaaaacaactactgtaggagttgtcattccaaatattgtaaatagctattttgctactctagctaaaggtattgatgacattgcaaccatgtataagtataatattgttcttgcttccagtgatgataatgaggatcatgaagttacagtcattcattctctaatttctaaacaagttgatggtattatttttatgggacaccatctgacagaaaaaatccgtgcagaattctctcgtacccgtacaccgattgttctagcaggaacagttgatctcgaacaccaaataccaagtgttaacatcgactataaagctgccgttgaggattgtgtaacgcaacttgctaaaaataatgaaaaggttgcctttgtatcaggaccactaattgatgatattaatggcaaactacgtttggctgggtataagtctggacttgaaaagaataatttgagctacaacgaaggacttgtctttgaagctaaatatagctataaagacggctttgagttagcacaacgtgtcttgaactctggtgccactgctgcctatgttggggaagatgaattggctgcaggtctcttgaatggcctctttgctgcaggcaaatcagttccagaagatttcgaaatcatcacaagcaatgattcaccggttacaagctacacacgtccaaacctttctagtataaaccatcctctctatgatttaggggcagttagcatgcgtatgttgactaaaattatgcataaggaagaacttgaagagaaagacgttattcttaatcatggtctaactttacgccagtcaacaaaataa

SEQ ID NO: 69 - DNA, 1002 bp, Streptococcus thermophilus
atgaatactgatgaaacaatcacaatttatgatgtagcgcgtgaagctggagtatcgatggcaactgtttctcgtgttgtaaatggtaacaaaaacgtaaaagaaaacacccgaaaaaaagtgctcgaagtcattgatcgtttggattaccgtccaaatgcggttgcgcgtggcttggcaagtaaaaaaacaactactgtaggagttgtcattccaaatattgtaaatagctattttgctactctagctaaaggtattgatgacattgcaaccatgtataagtataatattgttcttgcttccagtgatgataatgaggatcatgaagttacagtcattcattctctaatttctaaacaagttgatggtattatttttatgggacaccatctgacagaaaaaatccgtgcagaattctctcgtacccgtacaccgattgttctagcaggaacagttgatctcgaacaccaaataccaagtgttaacatcgactataaagctgccgttgaggattgtgtaacgcaacttgctaaaaataatgaaaaggttgcctttgtatcaggaccactaattgatgatattaatggcaaactacgtttggctgggtataagtctggacttgaaaagaataatttgagctacaacgaaggacttgtctttgaagctaaatatagctataaagacggctttgagttagcacaacgtgtcttgaactctggtgccactgctgcctatgttggggaagatgaattggctgcaggtctcttgaatggcctctttgctgcaggcaaatcagttccagaagatttcgaaatcatcacaagcaatgattcaccggttacaagctacacacgtccaaacctttctagtataaaccatcctctctatgatttaggggcagttagcatgcgtatgttgactaaaattatgcataaggaagaacttgaagataaagacgttattcttaatcatggtctaactttacgccagtcaacaaaataa

SEQ ID NO: 70 - DNA, 1002 bp, Streptococcus thermophilus
atgaatactgatgaaacaatcacaatttatgatgtagcgcgtgaagctggagtatcgatggcaactgtttctcgtgttgtaaatggtaacaaaaacgtaaaagaaaacacccgaaaaaaagtgctcgaagtcattgatcgtttggattaccgtccaaatgcggttgcgcgtggcttggcaagtaaaaaaacaactactgtaggagttgtcattccaaatattgtaaatagctattttgctactctagctaaaggtattgatgacattgcaaccatgtataagtataatattgttcttgcttccagtgatgataatgaggatcatgaagttacagtcattcattctctaatttctaaacaagttgatggtattatttttatgggacaccatctgacagaaaaaatccgtgcagaattctctcgtacccgtacaccgattgttctagcaggaacagttgatctcgaacaccaattaccaagtgttaacatcgactataaagctgccgttgaggattgtgtaatgcaacttgctaaaaataatgaaaaggttgcctttgtatcaggaccactaattgatgatattaatggcaaactacgtttggctgggtataagtctggacttgaaaagaataatttgagctacaacgaaggacttgtctttgaagctaaatatagctataaagacggctttgagttagcacaacgtgtcttgaactctggtgccactgctgcctatgttggggaagatgaattggctgcaggtctcttgaatggcctctttgctgcaggcaaatcagttccagaagatttcgaaatcatcacaagcaatgattcaccggttacaagctacacacgtccaaacctttctagtataaaccatcctctctatgatttaggggcagttagcatgcgtatgttgactaaaattatgcataaggaagaacttgaagagaaagacgttattcttaatcatggtctaactttacgccagtcaacaaaataa

SEQ ID NO: 71 - DNA, 1001 bp, Streptococcus thermophilus
atgaatactgatgaaacaatcacaatttatgatgtagcgcgtgaagctggagtatcgatggcaactgtttctcgtgttgtaaatggtaacaaaaacgtaaaagaaaacacccgaaaaaagtgctcgaagtcattgatcgtttggattaccgtccaaatgcggttgcgcgtggcttggcaagtaaaaaaacaactactgtaggagttgtcattccaaatattgtaaatagctattttgctactctagctaaaggtattgatgacattgcaaccatgtataagtataatattgttcttgcttccagtgatgataatgaggatcatgaagttacagtcattcattctctaatttctaaacaagttgatggtattatttttatgggacaccatctgacagaaaaaatccgtgcagaattctctcgtacccgtacaccgattgttctagcaggaacagttgatctcgaacaccaattaccaagtgttaacatcgactataaagctgccgttgaggattgtgtaacgcaacttgctaaaaataatgaaaaggttgcctttgtatcaggaccactaattgatgatattaatggcaaactacgtttggccgggtataagtctggacttgaaaagaataatttgagctacaacgaaggacttgtctttgaagctaaatatagctataaagacggctttgagttagcacaacgtgtcttgaactctggtgccactgctgcctatgttggggaagatgaattggctgcaggtctcttgaatggcctctttgctgcaggcaaatcagttccagaagatttcgaaatcatcacaagcaatgattcaccggttacaagctacacacgtccaaacctttctagtataaaccatcctctctatgatttaggggcagttagcatgcgtatgttgactaaaattatgcataaggaagaacttgaagataaagacgttattcttaatcatggtctaactttacgccagtcaacaaaataa

SEQ ID NO: 72 - DNA, 1001 bp, Streptococcus thermophilus
atgaatactgatgaaacaatcacaatttatgatgtagcgcgtgaagctggagtatcgatggcaactgtttctcgtgttgtaaatggtaacaaaaacgtaaaagaaaacacccgaaaaaagtgctcgaagtcattgatcgtttggattaccgtccaaatgcggttgcgcgtggcttggcaagtaaaaaaacaactactgtaggagttgtcattccaaatattgtaaatagctattttgctactctagctaaaggtattgatgacattgcaaccatgtataagtataatattgttcttgcttccagtgatgataatgaggatcatgaagttacagtcattcattctctaatttctaaacaagttgatggtattatttttatgggacaccatctgacagaaaaaatccgtgcagaattctctcgtacccgtacaccgattgttctagcaggaacagttgatctcgaacaccaattaccaagtgttaacatcgactataaagctgccgttgaggattgtgtaacgcaacttgctaaaaataatgaaaaggttgcctttgtatcaggaccactaattgatgatattaatggcaaactacgtttggctgggtataagtctggacttgaaaagaataatttgagctacaacgaaggacttgtctttgaagctaaatatagctataaagacggctttgatttagcacaacgtgtcttgaactctggtgccactgctgcctatgttggggaagatgaattggctgcaggtctcttgaatggcctctttgctgcaggcaaatcagttccagaagatttcgaaatcatcacaagcaatgattcaccggttacaagctacacacgtccaaacctttctagtataaaccatcctctctatgatttaggggcagttagcatgcgtatgttgactaaaattatgcataaggaagaacttgaagataaagacgttattcttaatcatggtctaactttacgccagtcaacaaaataa

SEQ ID NO: 73 - DNA, 1001 bp, Streptococcus thermophilus
atgaatactgatgaaacaatcacaatttatgatgtagcgcgtgaagctggagtatcgatggcaactgtttctcgtgttgtaaatggtaacaaaaacgtaaaagaaaacacccaaaaaaagtgctcgaagtcattgatcgtttggattaccgtccaaatgcggttgcgcgtggcttggcaagtaaaaaaacaactactgtaggagttgtcattccaaatattgtaaatagctattttgctactctagctaaaggtattgatgacattgcaaccatgtataagtataatattgttcttgcttccagtgatgataatgaggatcatgaagttacagtcattcattctctaatttctaaacaagttgatggtattatttttatgggacaccatctgacagaaaaaatccgtgcagaattctctcgtacccgtacaccgattgttctagcaggaacagttgatctcgaacaccaattaccaagtgttaacatcgactataaagctgccgttgaggattgtgtaacgcaacttgctaaaaataatgaaaaggttgcctttgtatcaggaccactaattgatgatattaatggcaaactacgtttggctgggtataagtctggacttgaaaagaataatttgagctacaacgaaggacttgtctttgaagctaaatatagctataaagacggctttgagttagcacaacgtgtcttgaactctggtgccactgctgcctatgttggggaagatgaattggctgcaggtctcttgaatggcctctttgctgcaggcaaatcagttccagaagatttcgaaatcatcacaagcaatgattcaccggttacaagctacacacgtccaaacctttctagtataaaccatcctctctatgatttaggggcagttagcatgcgtatgttgactaaaattatgcataaggaagaacttgaagataaagacgttattcttaatcatggtctaactttacgccagtcaacaaaataa

SEQ ID NO: 74 - DNA, 1001 bp, Streptococcus thermophilus
atgaatactgatgaaacaatcacaatttatgatgtagcgcgtgaagctggagtatcgatggcaactgtttctcgtgttgtaaatggtaacaaaaacgtaaaagaaaacacccgaaaaaagtgctcgaagtcattgatcgtttggattaccgtccaaatgcggttgcgcgtggcttggcaagtaaaaaaacaactactgtaggagttgtcattccaaatattgtaaatagctattttgctactctagctaaaggtattgatgacattgcaaccatgtataagtataatattgttcttgcttccagtgatgataatgaggatcatgaagttacagtcattcattctctaatttctaaacaagttgatggtattatttttatgggacaccatctgacagaaaaaatccgtgcagaattctctcgtacccgtacaccgattgttctagcaggaacagttgatctcgaacaccaaataccaagtgttaacatcgactataaagctgccgttgaggattgtgtaacgcaacttgctaaaaataatgaaaaggttgcctttgtatcaggaccactaattgatgatattaatggcaaactacgtttggctgggtataagtctggacttgaaaagaataatttgagctacaacgaaggacttgtctttgaagctaaatatagctataaagacggctttgagttagcacaacgtgtcttgaactctggtgccactgctgcctatgttggggaagatgaattggctgcaggtctcttgaatggcctctttgctgcaggcaaatcagttccagaagatttcgaaatcatcacaagcaatgattcaccggttacaagctacacacgtccaaacctttctagtataaaccatcctctctatgatttaggggcagttagcatgcgtatgttgactaaaattatgcataaggaagaacttgaagagaaagacgttattcttaatcatggtctaactttacgccagtcaacaaaataa

SEQ ID NO: 75 - DNA, 1001 bp, Streptococcus thermophilus
atgaatactgatgaaacaatcacaatttatgatgtagcgcgtgaagctggagtatcgatggcaactgtttctcgtgttgtaaatggtaacaaaaacgtaaaagaaaacacccgaaaaaagtgctcgaagtcattgatcgtttggattaccgtccaaatgcggttgcgcgtggcttggcaagtaaaaaaacaactactgtaggagttgtcattccaaatattgtaaatagctattttgctactctagctaaaggtattgatgacattgcaaccatgtataagtataatattgttcttgcttccagtgatgataatgaggatcatgaagttacagtcattcattctctaatttctaaacaagttgatggtattatttttatgggacaccatctgacagaaaaaatccgtgcagaattctctcgtacccgtacaccgattgttctagcaggaacagttgatctcgaacaccaaataccaagtgttaacatcgactataaagctgccgttgaggattgtgtaacgcaacttgctaaaaataatgaaaaggttgcctttgtatcaggaccactaattgatgatattaatggcaaactacgtttggctgggtataagtctggacttgaaaagaataatttgagctacaacgaaggacttgtctttgaagctaaatatagctataaagacggctttgagttagcacaacgtgtcttgaactctggtgccactgctgcctatgttggggaagatgaattggctgcaggtctcttgaatggcctctttgctgcaggcaaatcagttccagaagatttcgaaatcatcacaagcaatgattcaccggttacaagctacacacgtccaaacctttctagtataaaccatcctctctatgatttaggggcagttagcatgcgtatgttgactaaaattatgcataaggaagaacttgaagataaagacgttattcttaatcatggtctaactttacgccagtcaacaaaataa

SEQ ID NO: 76 - DNA, 1001 bp, Streptococcus thermophilus
atgaatactgatgaaacaatcacaatttatgatgtagcgcgtgaagctggagtatcgatggcaactgtttctcgtgttgtaaatggtaacaaaaacgtaaaagaaaacacccgaaaaaagtgctcgaagtcattgatcgtttggattaccgtccaaatgcggttgcgcgtggcttggcaagtaaaaaaacaactactgtaggagttgtcattccaaatattgtaaatagctattttgctactctagctaaaggtattgatgacattgcaaccatgtataagtataatattgttcttgcttccagtgatgataatgaggatcatgaagttacagtcattcattctctaatttctaaacaagttgatggtattatttttatgggacaccatctgacagaaaaaatccgtgcagaattctctcgtacccgtacaccgattgttctagcaggaacagttgatctcgaacaccaattaccaagtgttaacatcgactataaagctgccgttgaggattgtgtaatgcaacttgctaaaaataatgaaaaggttgcctttgtatcaggaccactaattgatgatattaatggcaaactacgtttggctgggtataagtctggacttgaaaagaataatttgagctacaacgaaggacttgtctttgaagctaaatatagctataaagacggctttgagttagcacaacgtgtcttgaactctggtgccactgctgcctatgttggggaagatgaattggctgcaggtctcttgaatggcctctttgctgcaggcaaatcagttccagaagatttcgaaatcatcacaagcaatgattcaccggttacaagctacacacgtccaaacctttctagtataaaccatcctctctatgatttaggggcagttagcatgcgtatgttgactaaaattatgcataaggaagaacttgaagagaaagacgttattcttaatcatggtctaactttacgccagtcaacaaaataa

SEQ ID NO: 77 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatctatgaacatgactgaaaaaattcaaacttatttaaacgatccaaagattgttagcgttaatactgttgatgctcactcagatcataagtattttgaatctcttgaagaattttctgaaggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccaatatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttattctacagcaagctggttggaagaccaagacttctggagactttacggtatttttagagatgtttacttgtatgctattccaaaagttcacgttcaagatctctttgttaagggagattatgattaccaaacaaaagcaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacgatttgatccttcatgttttggatgatgaccaagttgttgaagtcgttccagttaaagttggatttagacgctttgaaattaaagataaacttatgcttttgaatggtaagagaattgtctttaaaggggttaacagacacgaatttaacgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattacttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagcgttagtgataaacactttgcttcaggtaacctaactaacaaacctcaaaaaccttatatttcatgtgaatacatgcacacaatgggtaactctggtggtggattgcaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtatcgtctttgcagatcgtaccctaactccaaaacttcaaacagttaaacatctttactctaatattaagattgctgttgatgaaaaatcagtaactatcaagaatgataatctcttcgaagatctttctgcttatactttcctagctagagtttacgaagatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactgaatgggctcctaaaggtcatgaaattgttcgtggtcaatatgttgttgaaaagattagcactgaaacaccagttaaagcacctttgaatgttgttgaaggcgacttcaacatcggtattcaaggacaaaacttctcaatcttgctttcacgtgcacaaaatactttagtatctgctaagtataatggtgttgaattcattgagaaaggtcctaaacttagcttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgattacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgacacatggggtgctccagttcatgacgaattcttgcttagctcagcagatagctatcaattaagcttcatgattgaaccactaaattaggtagttattaagaatctagttgta

SEQ ID NO: 78 - protein, 1026 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDTWGAPVHDEFLLSSADSYQLSFMIEPLN

SEQ ID NO: 79 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatctatgaacatgactgaaaaaattcaaacttatttaaacgatccaaagattgttagcgttaatactgttgatgctcactcagatcataagtattttgaatctcttgaagaattttctgaaggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccaatatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagactttacggtatttttagagatgtttacttgtatgctattccaaaagttcacgttcaagatctctttgttaagggagattatgattaccaaacaaaaacaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacgatttgatccttcatgttttggatgatgaccaagttgttgaagtcgttccagttaaagttggatttagacgctttgaaattaaagataaacttatgcttttgaatggtaagagaattatctttaaaggggttaacagacacgaatttaacgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattacttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagcgttagtgataaacactttgcttcaggtaacctaactaacaaacctcaaaaaccttatatttcatgtgaatacatgcacacaatgggtaactctggtggtggattgcaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtatcgtctttgcagatcgtaccctaactccaaaacttcaaacagttaaacatctttactctaatattaagattgctgttgatgaaaaatcagtaactatcaagaatgataatctcttcgaagatctttctgcttatactttcctagctagagtttacgaagatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactgaatgggctcctaaaggtcatgaaattgttcgtggtcaatatgttgttgaaaagattagcactgaaacaccagttaaagcacctttgaatgttgttgaaggcgacttcaacatcggtattcaaggacaaaacttctcaatcttgctttcacgtgcacaaaatactttagtatctgctaagtataatggtgttgaattcattgagaaaggtcctaaacttagcttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgactacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgacacatggggtgctccagttcatgacgaattcttgcttagctcagcagatagctatcaattaagcttcatgattgaaccactaaattaggtagttattaagaatctagttgta

SEQ ID NO: 80 - protein, 1026 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKTGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIIFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDTWGAPVHDEFLLSSADSYQLSFMIEPLN

SEQ ID NO: 81 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatctatgaacatgactgaaaaaattcaaacttatttaaacgatccaaagattgttagcgttaatactgttgatgctcactcagatcataagtattttgaatctcttgaagaattttctgaaggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccaatatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagactttacggtatttttagagatgtttacttgtatgctattccaaaagttcacgttcaagatctctttgttaagggagattatgattaccaaacaaaagcaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacgatttgatccttcatgttttggatgatgaccaagttgttgaagtcgttccagttaaagttggatttagacgctttgaaattaaagataaacttatgcttttgaatggtaagagaattgtctttaaaggggttaacagacacgaatttaacgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattacttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagcgttagtgataaacactttgcttcaggtaacctaactaacaaacctcaaaaaccttatatttcatgtgaatacatgcacacaatgggtaactctggtggtggattgcaactctacactgacttagagaaatatccagaataccaaggtggatttatttgggacttcattgaccaagctatttacaaaacacttccaaatggtagcgaattcctatcatatggtggtgactggcatgatagaccttctgactatgaattttgtggaaatggtatcgtctttgcagatcgtaccctaactccaaaacttcaaacagttaaacatctttactctaatattaagattgctgttgatgaaaaatcagtaactatcaagaatgataatctcttcgaagatctttctgcttatactttcctagctagagtttacgaagatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactgaatgggctcctaaaggtcatgaaattgttcgtggtcaatatgttgttgaaaagattagcactgaaacaccagttaaagcacctttgaatgttgttgaaggcgacttcaacatcggtattcaaggacaaaacttctcaatcttgctttcacgtgcacaaaatactttagtatctgctaagtataatggtattgaattcattgagaaaggtcctaaacttagcttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgactacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagcattcgaattcagtgctttgcgcaacagtactgaacaaattgaaaatgctcgtcaccaatatgagttgcaagaatctgatgctacatggattaaagttcttgctgctcaaatgggtgtaggtggtgacgactcatggggttctccagttcatgacgaattcttgcttagctcagcagatagctatcaattaagcttcatgattgaaccactaaattaggtagttattaagaatctagttgta

SEQ ID NO: 82 - protein, 1026 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGIEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDSWGSPVHDEFLLSSADSYQLSFMIEPLN

SEQ ID NO: 83 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatttatgaacacgactgaaaaaattcaaacttacttaaacgatccaaagattgttagcgttaatactgttgacgctcactcagatcataagtattttgaatctcttgcagaattttctgagggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccagtatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagactttacggtatttttagagatgtttacttgtatgctattccaaaagttcacgttcaagatctctttgttaagggagattatgattaccaaacaaaagcaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacaatttgatccttcatgttttggatgatgaccaagttgttgaagtcgttccagttaaagttggatttagacgctttgaaattaaagataaacttatgcttttgaatggtaagagaattgtctttaaaggggttaacagacacgaatttaatgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattatttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagagttagtgataaacactttgcttcaggtaacctaactaacaatcctcaaaaaccttatatttcatgtgaatacatgcacacaatgggtaactctggtggtggattggaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtattgtctttgcagatcgtaccctaactccaaaacttcaaacagttaaacatctttactctaatattaagattgctgttgatgaaaaatcagtaactatcaagaatgataatgtcttcgaagatctttctgcttatactttcctagctagagtttacgaagatggtagaaaagttagtgaaagtgaatatcactttgatgttaaaccaggcgaagaagcaacattcccagttaactttgtagtcgagtcttcaaattctgaacaaatttacgaagttgcttgtgttctgagggaagcaactgaatgggctcctaaaggtcatgaaattgttcgtggtcaatatgttgttgaaaagattagcactgaaacaccagttaaagcacctttgaatgttgttgaaggcgacttcaacatcggtattcaaggacaaaacttctcaatcttgctttcacgtgcacaaaatactttagtatctgctaagtataatggtgttgaattcattgagaaaggtcctaaacttaacttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgactacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgactcatggggtgctccagttcatgacgaattcttgcttagctcagcagatagctatcaattaagcttcatgattgaaccactaaattaggtagttattaagaatctagttgta

SEQ ID NO: 84 - protein, 1026 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSRVSDKHFASGNLTNNPQKPYISCEYMHTMGNSGGGLELYTDLEKYPEYQGGFIWDFIDQAIYKTLPNGSEFLSYGGDWHDRPSDYEFCGNGIVFADRTLTPKLQTVKHLYSNIKIAVDEKSVTIKNDNVFEDLSAYTFLARVYEDGRKVSESEYHFDVKPGEEATFPVNFVVESSNSEQIYEVACVLREATEWAPKGHEIVRGQYVVEKISTETPVKAPLNVVEGDFNIGIQGQNFSILLSRAQNTLVSAKYNGVEFIEKGPKLNFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDSWGAPVHDEFLLSSADSYQLSFMIEPLN

SEQ ID NO: 85 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatttatgaacacgactgaaaaaattcaaacttacttaaacgatccaaagattgttagcgttaatactgttgacgctcactcagatcataagtattttgaatctcttgcagaattttctgagggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccagtatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagactttacggtatttttagagatgtttacttgtatgctattccaaaagttcacgttcaagatctctttgttaagggagattatgattaccaaacaaaagcaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacaatttgatccttcatgttttggatgatgaccaagttgttgaagtcgttccagttaaagttggatttagacgctttgaaattaaagataaacttatgcttttgaatggtaagagaattgtctttaaaggggttaacagacacgaatttaatgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattatttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagagttagtgataaacactttgcttcaggtaacctaactaacaaacctcaaaaaccttatatttcatgtgaatacatgcacacaatgggtaactctggtggtggattggaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtattgtctttgcagatcgtaccctaactccaaaacttcaaacagttaaacatctttactctaatattaagattgctgttgatgaaaaatcagtaactatcaagaatgataatgtcttcgaagatctttctgcttatactttcctagctagagtttacgaaaatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactgaatgggctcctaaaggtcatgaaattgttcgtggtcaatatgttgttgaaaagattagcactgaaacaccagtcaaagcacctttgaatgttgttgaaggcgacttcaacatcggtattcaaggacaaaacttctcaatcttgctttcacgtgcacaaaatactttagtatctgctaagtataatggtgttgaattcattgagaaaggtcctaaacttaacttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgactacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttcaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgactcatggggtgctccagttcatgacgaattcttgcttagctcagcagatagctatcaattaagcttcatgattgaaccactaaattaggtagttattaagaatctagttgta

SEQ ID NO: 86 - protein, 1026 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSRVSDKHFASGNLTNKPQKPYISCEYMHTMGNSGGGLELYTDLEKYPEYQGGFIWDFIDQAIYKTLPNGSEFLSYGGDWHDRPSDYEFCGNGIVFADRTLTPKLQTVKHLYSNIKIAVDEKSVTIKNDNVFEDLSAYTFLARVYENGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLNFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVQKTFAPYLMPQESGNHYGTREFTVSDDNHNGLKFTALNKAFEFSALRNSTEQIENARHQYELQESDATWIKVLAAQMGVGGDDSWGAPVHDEFLLSSADSYQLSFMIEPLN

SEQ ID NO: 87 - DNA, 3232 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatttatgaacacgactgaaaaaattcaaacttacttaaacgatccaaagattgttagcgttaatactgttgacgctcactcagatcataagtattttgaatctcttgcagaattttctgagggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccagtatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagactttacggtatttttagagatgtttacttgtatgctattccaaaagttcacgttcaagatctctttgttaagggagattatgattaccaaacaaaaacaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacgatttgatccttcatgttttggatgatgaccaagttgttgaagtcgttccagttaaagttggatttagacgctttgaaattaaagataaacttatgcttttgaatggtaagagaattatctttaaaggggttaacagacacgaatttaacgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattacttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagcgttagtgataaacactttgcttcaggtaacctaactaacaaacctcaaaaaccttatatttcatgtgaatacatgcacacaatgggtaactctggtggtggattgcaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtatcgtctttgcagatcgtaccctaactccaaaacttcaaacagttaaacatctttactctaatattaagattgctgttgatgaaaaatcagtaactatcaagaatgataatctcttcgaagatctttctgcttatactttcctagctagagtttacgaagatggtagaaaagttagtgaaagtgaatatcactttgatgttaaaccaggcgaagaagcaacattcccagttaactttgtagttgaggcttcaaattctgaacaaatttacgaagttgcttgtgttctgagggaagcaactaaatgggctcctaaaggtcatgaaattgttcgtggtcaatatgttgttgaaaagattagcactgaaacaccagttaaagcacctttgaatgttgttgaaggggacttcaacatcggtattcaaggacaaaacttctcaatcttgctttcacgtgcacaaaatactttagtatctgctaagtataatggtgttgaattcattgagaaaggtcctaaacttagcttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgactacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgactcatggggtgctccagttcatgacgaattcttgcttagctcagcagatagctatcaattaagcttcatgattgaaccactaaattaggtagttattaagaatcctagttgta

SEQ ID NO: 88 - protein, 1026 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKTGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIIFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATKWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDSWGAPVHDEFLLSSADSYQLSFMIEPLN

SEQ ID NO: 89 - DNA, 3231 bp, Streptococcus thermophilus
gatgacacagtacttgtcactgtaactaattcagaaaaattcagtgctttccatcttgaacaagaagttggagaaaaggtagaagctttgtctgaagttattaccttcaaaaaaggagaataatttatgaacacgactgaaaaaattcaaacttacttaaacgatccaaagattgttagcgttaatactgttgacgctcactcagatcataagtattttgaatctcttgcagaattttctgagggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccagtatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagactttacggtatttttagagatgtttacttgtatgctattccaaaagttcacgttcaagatctctttgttaagggagattatgattaccaaacaaaagcaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacaatttgatccttcatgttttggatgatgaccaagttgttgaagtcgttccagttaaagttggatttagacgctttgaaattaaagatagacttatgcttttgaatggtaagagaattgtctttaaaggggttaacagacacgaatttaatgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattatttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagagttagtgataaacactttgcttcaggtaacctaactaacaaacctcaaaaaccttatatttcatgtgaatacatgcacacaatgggtaactctggtggtggattggaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtattgtctttgcagatcgtaccctaactccaaaacttcaaacagttaaacatctttactctaatattaagattgctgttgatgaaaaatcagtaactatcaagaatgataatgtcttcgaagatctttctgcttatactttcctagctagagtttacgaagatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactgaatgggctcctaaaggtcatgaaattgttcgtggtcaatatgttgttgaaaagattagcactgaaacaccagtcaaagcacctttgaatgttgttgaaggtgacttcaacatcggtattcaaggacaaaacttctcaatcttgctttcacgtgcacaaaatactttagtatctgctaagtataatggtgttgaattcattgagaaaggtcctaaacttaacttcactcgtgcttacactgacaacgatcgtggtgctggatatccattcgaaatggcaggatggaaggttgctggaaactatagtaaagttacagatactcaaattcaaatcgaagacgactctgttaaagtgacttatgttcatgaattgccaggcttgtctgatgtcgaagttaaggtaacttatcaagttgactacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgactcatggggtgctccagttcatgacgaattcttgcttagctcagcagatagctatcaattaagcttcatgattgaaccactaaattaggtagttattaagaatctagttgta

SEQ ID NO: 90 - protein, 1026 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDRLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSRVSDKHFASGNLTNKPQKPYISCEYMHTMGNSGGGLELYTDLEKYPEYQGGFIWDFIDQAIYKTLPNGSEFLSYGGDWHDRPSDYEFCGNGIVFADRTLTPKLQTVKHLYSNIKIAVDEKSVTIKNDNVFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLNFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDSWGAPVHDEFLLSSADSYQLSFMIEPLN

SEQ ID NO: 91 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatctatgaacatgactgaaaaaattcaaacttatttaaacgatccaaagattgttagcgttaatactgttgatgctcactcagatcataagtattttgaatctcttgaagaattttctgaaggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccaatatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagacttcacggtatttttagagatgtttacttgtatgctattccaaaagttcacgttcaagatctctttgttaagggagattatgattaccaaacaaaatcaggtcaattggatattgatttgaagactgttggtgattatgaagacaagaagattaaatatgttctttcagattatgaaggtatcgttacagaaggtgatgcatctgttaatggtgacggtgaactatctgtaagtcttgaaaatcttaaaatcaaaccttggagtgctgaaagtcctaaactttacgatttgatccttcatgttttggatgaagaccaagttgttgaagtcgttccagttaaagttggattcagacgctttgaaattaaagataaacttatgcttttgaatggtaagagaattgtctttaaaggggttaacagacacgaatttaacgctagaacaggacgttgtatcactgaagaagatatgctttgggatatcaaagtgatgaagcaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattacttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagcgttagtgataaacactttgcttcaggtaacctaactaacaaacctcaaaaaccttatatttcatgtgaatacatgcacacaatgggtaactctggtggtggattgcaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtatcgtctttgcagatcgtaccctaactccaaaacttcaaacagttaaacatctttactctaatattaagattgctgttgatgaaaaatcagtaactatcaagaatgataatctcttcgaagatctttctgcttatactttcctagctagagtttacgaagatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactaaatgggctcctaaaggtcatgaaattgttcgtggtcaatatgttgttgaaaagattagcactgaaacaccagttaaagcacctttgaatgttgttgaaggcgacttcaacatcggtattcaaggacaaaacttctcaatcttgctttcacgtgcacaaaatactttagtatctgctaagtataatggtgttgaattcattgagaaaggtcctaaacttagcttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgactacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgacacatggggtgctccagttcatgacgaattcttgcttagctcagcagatagctatcaattaagcttcatgattgaaccactaaattaggtagttattaagaatctagttgta

SEQ ID NO: 92 - protein, 1026 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLHGIFRDVYLYAIPKVHVQDLFVKGDYDYQTKSGQLDIDLKTVGDYEDKKIKYVLSDYEGIVTEGDASVNGDGELSVSLENLKIKPWSAESPKLYDLILHVLDEDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATKWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDTWGAPVHDEFLLSSADSYQLSFMIEPLN

SEQ ID NO: 93 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatctatgaacatgactgaaaaaattcaaacttatttaaacgatccaaagattgttagcgttaatactgttgacgctcactcagatcataagtattttgaatctcttgcagaattttctgagggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccagtatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagactttacggtatttttagagatgtttacttgtatgctattccaaaagttcacgttcaagatctctttgttaagggagattatgattaccaaacaaaaacaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacgatttgatccttcatgttttggatgatgaccaagttgttgaagtcgttccagttaaagttggatttagacgctttgaaattaaagataaacttatgcttttgaatggtaagagaattatctttaaaggggttaacagacacgaatttaacgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattacttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagcgttagtgataaacactttgcttcaggtaacctaactaacaaacctcaaaaaccttatatttcatgtgaatacatgcacacaatgggtaactctggtggtggattgcaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtatcgtctttgcagatcgtaccctaactccaaaacttcaaacagttaaacatctttactctaatattaagattgctgttgatgaaaaatcagtaactatcaagaatgataatctcttcgaagatctttctgcttatactttcctagctagagtttacgaagatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactgaatgggctcctaaaggtcatgaaattgttcgtggtcaatatgttgttgaaaagattagcactgaaacaccagttaaagcacctttgaatgttgttgaaggcgacttcaacatcggtattcaaggacaaaacttctcaatcttgctttcacgtgcacaaaatactttagtatctgctaagtataatggtgttgaattcattgagaaaggtcctaaacttagcttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgattacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgacacatggggtgctccagttcatgacgaattcttgcttagctcagcagatagctatcaattaagcttcatgattgaaccactaaattaggtagttattaagaatctagttgta

SEQ ID NO: 94 - protein, 1026 aa, Streptococcus thermophilus
MNMTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKTGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIIFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDTWGAPVHDEFLLSSADSYQLSFMIEPLN

SEQ ID NO: 95 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatctatgaacatgactgaaaaaattcaaacttatttaaacgatccaaagattgttagcgttaatactgttgatgctcactcagatcataagtattttgaatctcttgaagaattttctgaaggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccaatatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagactttacggtatttttagagatgtttacttgtatgctattccaaaagttcacgttcaagatctctttgttaagggagattatgattaccaaacaaaagcaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaggtcctaaactttacgatttgatccttcatgttttggatgatgaccaagttgttgaagtcgttccagttaaagttggatttagacgctttgaaattaaagataaacttatgcttttgaatggtaagagaattgtctttaaaggggttaacagacacgaatttaacgctagaacaggacgttgtatcactgaagaagatatgctttgggatatcaaagtgatgaaacaacataatatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtaaaccagaatggttgcctgcttgtttggatcgtgccaataacatgttccaacgcgataagaaccacgctagtgttatcatttggtcttgtggtaatgaatcatatgctggtaaagatattgctgacatggctgattatttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagcgttagtgataaacactttgcttcaggtaacctaactaacaaacctcaaaaaccttatatttcatgtgaatacatgcacacaatgggtaactctggtggtggattggaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtattgtctttgcagatcgtaccctaactccaaaacttcaaacagttaaacatctttactctaatattaagattgctgttgatgaaaaatcagtaactatcaagaatgataatgtcttcgaagatctttctgcttatactttcctagctagagtttacgaagatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactgaatgggctcctaaaggtcatgaaattgttcgtggtcaatatgttgttgaaaagattagcactgaaacaccagtcaaagcacctttgaatgttgttgaaggtgacttcaacatcggtattcaaggacaaaacttctcaatcttgctttcacgtgcacaaaatactttagtatctgctaagtataatggtgttgaattcattgagaaaggtcctaaacttaacttcactcgtgcttacactgacaacgatcgtggtgctggatatccattcgaaatggcaggatggaaggttgctggaaactatagtaaagttacagatactcaaattcaaatcgaagacgactctgttaaagtgacttatgttcatgaattgccaggcttgtctgatgtcgaagttaaggtaacttatcaagttgactacaagggtcgaatctttgttactgcaaactatgatggtaaagcaggtttgccaaacttccctgaatttggtctagaatttgctatcggttcacaatttacaaaccttagctattatggatacggtgcagaagaaagctactgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgactcatggggtgctccagttcatgacgaattcttgcttagctcagcagatagctatcaattaagcttcatgattgaaccactaaattaggtagttattaagaatctagttgta

SEQ ID NO: 96 - protein, 1026 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAEGPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASKPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLELYTDLEKYPEYQGGFIWDFIDQAIYKTLPNGSEFLSYGGDWHDRPSDYEFCGNGIVFADRTLTPKLQTVKHLYSNIKIAVDEKSVTIKNDNVFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLNFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYCDKLPGAYLGRYETSVEKTFAPYLMPQESGNHYGTREFTVSDDNHNGLKFTALNKAFEFSALRNSTEQIENARHQYELQESDATWIKVLAAQMGVGGDDSWGAPVHDEFLLSSADSYQLSFMIEPLN

SEQ ID NO: 97 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatctatgaacatgactgaaaaaattcaaacttatttaaacgatccaaagattgttagcgttaatactgttgatgctcactcagatcataagtattttgaatctcttgaagaattttctgaaggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccaatatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagactttacggtatttttagagatgtttacttgtatgctattccaaaagttcacgttcaagatctctttgttaagggagattatgattaccaaacaaaagcaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacgatttgatccttcatgttttggatgatgaccaagttgttgaagtcgttccagttaaagttggatttagacgctttgaaattaaagataaacttatgcttttgaatggtaagagaattgtctttaaaggggttaacagacacgaatttaacgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattacttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagcgttagtgataaacactttgcttcaggtaacctaactaacaaacctcaaaaaccttttatttcatgtgaatacatgcacacaatgggtaactctggtggtggattgcaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtatcgtctttgcagatcgtaccctaactccaaaacttcaaacagttaaacatctttactctaatattaagattgctgttgatgaaaaatcagtaactatcaagaatgataatctcttcgaagatctttctgcttatactttcctagctagagtttacgaagatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactgaatgggctcctaaaggtcatgaaattgttcgtggtcaatatgttgttgaaaagattagcactgaaacaccagttaaagcacctttgaatgttgttgaaggcgacttcaacatcggtattcaaggacaaaacttctcaatcttgctttcacgtgcacaaaatactttagtatctgctaagtataatggtgttgaattcattgagaaaggtcctaaacttagcttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgattacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgacacatggggtgctccagttcatgacgaattcttgcttagctcagcagatagctatcaattaagcttcatgattgaaccactaaattaggtagttattaagaatctagttgta

SEQ ID NO: 98 - protein, 1026 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPFISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDTWGAPVHDEFLLSSADSYQLSFMIEPLN

SEQ ID NO: 99 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatctatgaacatgactgaaaaaattcaaacttatttaaacgatccaaagattgttagcgttaatactgttgatgctcactcagatcataagtattttgaatctcttgaagaattttctgaaggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccaatatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttattctacagcaagctggttggaagaccaagacttctggagactttacggtatttttagagatgtttacttgtatgctattccaaaagttcacgttcaagatctctttgttaagggagattatgattaccaaacaaaagcaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacgatttgatccttcatgttttggatgatgaccaagttgttgaagtcgttccagttaaagttggatttagacgctttgaaattaaagataaacttatgcttttgaatggtaagagaattgtctttaaaggggttaacagacacgaatttaacgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattacttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagcgttagtgataaacactttgcttcaggtaacctaactaacaaacctcaaaaaccttatatttcatgtgaatacatgcacacaatgggtaactctggtggtggattgcaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtatcgtctttgcagatcgtaccctaactccaaaacttcaaacagttaaacatctttactctaatattaagattgctgttgatgaaaaatcagtaactatcaagaatgataatctcttcgaagatctttctgcttatactttcctagctagagtttacgaagatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactgaatgggctcctaaaggtcatgaaattgttcgtggtcaatatgttgttgaaaagattagcactgaaacaccagttaaagcacctttgaatgttgttgaaggcgacttcaacatcggtattcaaggacaaaacttctcaatcttgctttcacgtgcacaaaatactttagtatctgctaagtataatggtgttgaattcattgagaaaggtcctaaacttagcttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgattacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcacctcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgacacatggggtgctccagttcatgacgaattcttgcttagctcagcagatagctatcaattaagcttcatgattgaaccactaaattaggtagttattaagaatctagttgta

SEQ ID NO: 100 - protein, 1026 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTSLNKAFEFSALRNSTEQIENARHQYELQESDATWIKVLAAQMGVGGDDTWGAPVHDEFLLSSADSYQLSFMIEPLN

SEQ ID NO: 101 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatttatgaacacgactgaaaaaattcaaacttacttaaacgatccaaagattgttagcgttaatactgttgacgctcactcagatcataagtattttgaatctcttgcagaattttctgagggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccaatatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttattctacagcaagctggttggaagaccaagacttctggagactttacggtatttttagagatgtttacttgtatgctattccaaaagttcacgttcaagatctctttgttaagggagattatgattaccaaacaaaagcaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacgatttgatccttcatgttttggatgatgaccaagttgttgaagtcgttccagttaaagttggatttagacgctttgaaattaaagataaacttatgcttttgaatggtaagagaattgtctttaaaggggttaacagacacgaatttaacgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaactttgtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattacttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagcgttagtgataaacactttgcttcaggtaacctaactaacaaacctcaaaaaccttatatttcatgtgaatacatgcacacaatgggtaactctggtggtggattgcaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtatcgtctttgcagatcgtaccctaactccaaaacttcaaacagttaaacatctttactctaatattaagattgctgttgatgaaaaatcagtaactatcaagaatgataatctcttcgaagatctttctgcttatactttcctagctagagtttacgaagatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactgaatgggctcctaaaggtcatgaaattgttcgtggtcaatatgttgttgaaaagattagcactgaaacaccagttaaagcacctttgaatgttgttgaaggcgacttcaacatcggtattcaaggacaaaacttctcaatcttgctttcacgtgcacaaaatactttagtatctgctaagtataatggtgttgaattcattgagaaaggtcctaaacttagcttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgattacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgacacatggggtgctccagttcatgacgaattcttgcttagctcagcagatagctatcaattaagcttcatgattgaaccactaaattaggtagttattaagaatctagttgta

SEQ ID NO: 102 - protein, 1026 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLCLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDTWGAPVHDEFLLSSADSYQLSFMIEPLN

SEQ ID NO: 103 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatttatgaacacgactgaaaaaattcaaacttacttaaacgatccaaagattgttagcgttaatactgttgacgctcactcagatcataagtattttgaatctcttgcagaattttctgagggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccagtatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagactttacggtatttttagagatgtttacttgtatgctattccaaaagttcacgttcaagatctctttgttaagggagattatgattaccaaacaaaagcaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacaatttgatccttcatgttttggatgatgaccaagttgttgaagtcgttccagttaaagttggatttagacgctttgaaattaaagataaacttatgcttttgaatggtaagagaattgtctttaaaggggttaacagacacgaatttaatgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattatttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagagttagtgataaacactttgcttcaggtaacctaactaacaaacctcaaaaaccttatatttcatgtgaatacatgcacacaatgggtaactctggtggtggattggaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtattgtctttgcagatcgtaccctaactccaaaacttcaaacagttaaacatctttactctaatattaagattgctgttgatgaaaaatcagtaactatcaagaatgataatgtcttcgaagatctttctgcttatactttcctagctagagtttacgaaaatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactgaatgggctcctaaaggtcatgaaattgttcgtggtcaatatgttgttgaaaagattagcactgaaacaccagtcaaagcacctttgaatgttgttgaaggtgacttcaacatcggtattcaaggacaaaacttctcaatcttgctttcacgtgcacaaaatactttagtatctgctaagtataatggtgttgaattcattgagaaaggtcctaaacttaacttcactcgtgcttacactgacaacgatcgtggtgctggatatccattcgaaatggcaggatggaaggttgctggaaactatagtaaagttacagatactcaaattcaaatcgaagacgactctgttaaagtgacttatgttcatgaattgccaggcttgtctgatgtcgaagttaaggtaacttatcaagttgactacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgactcatggggtgctccagttcatgacgaattcttgcttagctcagcagatagctatcaattaagcttcatgattgaaccactaaattaggtagttattaagaatctagttgta

SEQ ID NO: 104 - protein, 1026 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSRVSDKHFASGNLTNKPQKPYISCEYMHTMGNSGGGLELYTDLEKYPEYQGGFIWDFIDQAIYKTLPNGSEFLSYGGDWHDRPSDYEFCGNGIVFADRTLTPKLQTVKHLYSNIKIAVDEKSVTIKNDNVFEDLSAYTFLARVYENGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLNFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDSWGAPVHDEFLLSSADSYQLSFMIEPLN

SEQ ID NO: 105 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatttatgaacacgactgaaaaaattcaaacttacttaaacgatccaaagattgttagcgttaatactgttgacgctcactcagatcataagtattttgaatctcttgcagaattttctgagggggagatgaagttaagacaatctcttaatggaaaatggaaaattcactatgctcagaatacaaatcaggttttaaaaaacttttataaaacagaatttgatgaaactgatttgaatttcatcaatgtaccaggtcatttagagcttcaaggttttggttctccacaatatgtgaatacccagtatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagactttacggtatttttagagatgtttacttgtatgctattccaaaagttcacgttcaagatctctttgttaagggagattatgattaccaaacaaaagcaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacaatttgatccttcatgttttggatgatgaccaagttgttgaagtcgttccagttaaagttggatttagacgctttgaaattaaagataaacttatgcttttgaatggtaagagaattgtctttaaaggggttaacagacacgaatttaatgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattatttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagagttagtgataaacactttgcttcaggtaacctaactaacaaacctcaaaaaccttatatttcatgtgaatacatgcacacaatgggtaactctggtggtggattggaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtattgtctttgcagatcgtaccctaactccaaaacttcaaacagttaaacatctttactctaatattaagattgctgttgatgaaaaatcagtaactatcaagaatgataatgtcttcgaagatctttctgcttatactttcctagctagagtttacgaaaatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactgaatgggctcctaaaggtcatgaaattgttcgtggtcaatatgttgttgaaaagattagcactgaaacaccagttaaagcacctttgaatgttgttgaaggcgacttcaacatcggtattcaaggacaaaacttctcaatcttgctttcacgtgcacaaaatactttagtatctgctaagtataatggtgttgaattcattgagaaaggtcctaaacttaacttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgactacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttcaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgactcatggggtgctccagttcatgacgaattcttgcttagctcagcagatagctatcaattaagcttcatgattgaaccactaaattaggtagttattaagaatctagttgta

SEQ ID NO: 106 - protein, 1026 aa, Streptococcus thermophilus
MNTTEKIQTYLNDPKIVSVNTVDAHSDHKYFESLAEFSEGEMKLRQSLNGKWKIHYAQNTNQVLKNFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSRVSDKHFASGNLTNKPQKPYISCEYMHTMGNSGGGLELYTDLEKYPEYQGGFIWDFIDQAIYKTLPNGSEFLSYGGDWHDRPSDYEFCGNGIVFADRTLTPKLQTVKHLYSNIKIAVDEKSVTIKNDNVFEDLSAYTFLARVYENGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLNFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVQKTFAPYLMPQESGNHYGTREFTVSDDNHNGLKFTALNKAFEFSALRNSTEQIENARHQYELQESDATWIKVLAAQMGVGGDDSWGAPVHDEFLLSSADSYQLSFMIEPLN

SEQ ID NO: 107 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatctatgaacatgactgaaaaaattcaaacttatttaaacgatccaaagattgttagcgttaatactgttgatgctcactcagatcataagtattttgaatctcttgaagaattttctgaaggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccaatatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagactttacggtatttttagagatgtttacttgtatgctattccaaaagttcacgttcaagatctctttgttaagggagattatgattaccaaacaaaagcaggtcaattggatattgatttgaagactgttggtgattatgaagacaagaagattaaatatgttctttcagattatgaaggcatcgttacagaaggtgatgcatctgttaatggtgacggtgaactatctgtaagtcttgaaaatcttaaaatcaaaccttggagtgctgaaagtcctaaactttacgatttgatccttcatgttttggatgatgaccaagttgttgaagtcgttccagttaaagttggattcagacgctttgaaattaaagataaacttatgcttttgaatggtaagagaattgtctttaaaggggttaacagacacgaatttaacgctagaacaggacgttgtatcactgaagaagatatgctttgggatatcaaagtgatgaagcaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattacttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagcgttagtgataaacactttgcttcaggtaacctaactaacaaacctcaaaaaccttatatttcatgtgaatacatgcacacaatgggtaactctggtggtggattgcaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtatcgtctttgcagatcgtaccctaactccaaaacttcaaacagttaaacatctttactctaatattaagattgctgttgatgaaaaatcagtaactatcaagaatgataatctcttcgaagatctttctgcttatactttcctagctagagtttacgaagatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactgaatgggctcctaaaggtcatgaaattgttcgtggtcaatatgttgttgaaaagattagcactgaaacaccagttaaagcacctttgaatgttgttgaaggcgacttcaacatcggtattcaaggacaaaacttctcaatcttgctttcacgtgcacaaaatactttagtatctgctaagtataatggtgttgaattcattgagaaaggtcctaaacttagcttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgattacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagtattcgaattcagtgctttgcgtaacagtactgaacaaattgaaaatgctcgtcaccaatatgagttgcaagaatctgatgctacatggattaaagttcttgctgctcaaatgggtgtaggtggtgacgacacatggggtgctccagttcatgacgaattcttgcttagctcagcagatagctatcaattaagcttcatgattgaaccactaaattaggtagttattaagaatctagttgta

SEQ ID NO: 108 - protein, 1026 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKVFEFSALRNSTEQIENARHQYELQESDATWIKVLAAQMGVGGDDTWGAPVHDEFLLSSADSYQLSFMIEPLN

SEQ ID NO: 109 - DNA, 3231 bp, Streptococcus thermophilus
gatgacacagtacttgtcactgtaactaattcagaaaaattcagtgctttccatcttgaacaaaaagttggagaaaaggtagaagctttgtctgaagttattaccttcaaaaaaggagaataatctatgaacatgactgaaaaaattcaaacttatttaaacgatccaaagattgttagcgttaatactgttgatgctcactcagatcataagtattttgaatctcttgaagaattttctgaaggggagatgaagttaagacaatctcttaatggaaaatggaaaattcactatgctcagaatacaaatcaggttttaaaagacttttataaaacagaatttgatgaaactgatttgaatttcatcaatgtaccaggtcatttagagcttcaaggttttggttctccacaatatgtgaatacccaatatccttgggatggtaaagaattccttcgtccacctcaagttcctcaagaatcaaatgctgttgcatcatacgttaaacattttaccttgaatgatgcattaaaagataaaaaagtatttatctcattccaaggggttgctacttccatctttgtatgggtcaatggtaacttcgtaggatacagtgaagattcatttacacctagtgaatttgaaattagtgattaccttgttgaaggtgataacaagttggcggtagctgtttatcgttactctacagcaagctggttggaagaccaagacttctggagactttacggtatttttagagatgtttacttgtatgctattccaaaagttcacgttcaagatctctttgttaagggagattatgattaccaaacaaaagcaggtcaattggatattgatttgaagactgttggtgattatgaagacaagaagattaaatatgttctttcagattatgaaggcatcgttacagaaggtgatgcatctgttaatagtgacggtgaactatctgtaagtcttgaaaatcttaaaatcaaaccttggagtgctgaaagtcctaaactttacgatttgatccttcatgttttggatgatgaccaagttgttgaagtcgttccagttaaagttggatttagacgctttgaaattaaagataaacttatgcttttgaatggtaagagaattgtctttaaaggggttaacagacacgaatttaacgctagaacaggacgttgtatcactgaagaagatatgctttgggatatcaaagtgatgaaacaacataacatcaatgctgttcgtacttcacactatcctaaccaaacacgttggtatgaattgtgtgatgaatatggactttatgttatcgatgaagccaaccttgaaacacacggtacatggcaaaaacttggtctatgcgaaccttcatggaatatcccagctagtgaaccagaatggttgcctgcttgtttggatcgtgccaataacatgttccaacgcgataagaaccacgctagtgttatcatttggtcttgtggtaatgaatcatatgctggtaaagatattgctgacatggctgattacttccgtagtgttgacaatactcgtccagttcactatgaaggtgttgcatggtgtcgtgagtttgattacattacagacatcgaaagtcgtatgtatgcgaaaccagctgatatcgaagaatacctcacaactggtaaactagttgatctttcaagcgttagtgataaacactttgcttcaggtaacctaactaacaaacctcaaaaaccttatatttcatgtgaatacatgcacacaatgggtaactctggtggtggattgcaactctacactgacttagagaaatatccagaataccaaggtggatttatttgggacttcattgaccaagctatttacaaaacacttccaaatggtagcgaattcctatcatatggtggtgactggcatgatagaccttctgactacgaattttgtggaaatggtatcgtctttgcagatcgtaccctaactccaaaacttcaaacagttaaacatctttactctaatattaagattgctgttgatgaaaaatcagtaactatcaagaatgataatctcttcgaagatctttctgcttatactttcctagctagagtttacgaagatggtagaaaagttagtgaaagtgaatatcactttgatgttaaaccaggcgaagaagcaacattcccagttaactttgtagtcgaggcttcaaattctgaacaaatttacgaagttgcttgtgttctgagggaagcaactaaatgggctcctaaaggtcatgaaattgttcgtggtcaatatgttgttgaaaagattagcactgaaacaccagttaaagcacctttgaatgttgttgaaggcgacttcaacatcggtattcaaggacaaaacttctcaatcttgctttcacgtgcacaaaatactttagtatctgctaagtataatggtgttgaattcattgagaaaggtcctaaacttagcttcactcgtgcttacactgacaacgatcgtggtgctggatatccattcgaaatggcaggctggaaggttgctggaaactatagtaaagttacagatactcaaattcaaatcgaagacgactctgttaaagtgacttatgttcatgaattgccaggcttgtctgatgtcgaagttaaggtaacttatcaagttgattacaagggtcgaatctttgttactgcaaactatgatggtaaagcaggtttgccaaacttccctgaatttggtctagaatttgctatcggttcacaatttacaaaccttagctattatggatacggtgcagaagaaagctaccgtgataaacttcctggtgcctatcttggtcgatatgaaacatctgttgaaaagacatttgctccatatctaatgccacaagaatctggtaatcactatggtactcgtgaattcacagtatctgatgataaccataatggtcttaaattcaccgcacttaataaagcattcgaattcagtgctttgcgtaacagtactgaacaaattgaaaatgctcgtcaccaatatgagttgcaagaatctgatgctacatggattaaagttcttgctgctcaaatgggtgtaggtggtgacgacacatggggtgctccagttcatgacgaattcttgcttagctcagcagatagctatcaattaagcttcatgattgaaccactaaattaggtagttattaagaatctagttgta

SEQ ID NO: 110 - protein, 1026 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNSDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATKWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDTWGAPVHDEFLLSSADSYQLSFMIEPLN

SEQ ID NO: 111 - DNA, 264 bp, Streptococcus thermophilus
atggcttctaaagatttccacattgttgcagaaactggtattcacgcacgaccagctactttgcttgttcaaacagcaagtaaatttgcttcagatatcactcttgaatacaaaggtaaagcagttaaccttaaatctatcatgggtgttatgagtcttggtgttggtcaaggtgctgacgtaactatttctgcagaaggtcctgacgctgatgatgcaattgcagcaatcgcagaaacaatgacaaaagaaggattggcataa

SEQ ID NO: 112 - protein, 87 aa, Streptococcus thermophilus
MASKDFHIVAETGIHARPATLLVQTASKFASDITLEYKGKAVNLKSIMGVMSLGVGQGADVTISAEGPDADDAIAAIAETMTKEGLA

SEQ ID NO: 113 - DNA, 264 bp, Streptococcus thermophilus
atggcttctaaagatttccacattgttgcagaaactggtattcatgcacgaccagctactttgcttgttcaaacagcaagtaaatttgcttcagatatcactcttgaatacaaaggtaaagcagttaaccttaaatctatcatgggtgttatgagtcttggtgttggtcaaggtgctgacgtaactatttctgcagaaggtcctgacgctgatgctgcaattgcagcaatcgcagaaacaatgacaaaagaaggattggcataa

SEQ ID NO: 114 - protein, 87 aa, Streptococcus thermophilus
MASKDFHIVAETGIHARPATLLVQTASKFASDITLEYKGKAVNLKSIMGVMSLGVGQGADVTISAEGPDADAAIAAIAETMTKEGLA

SEQ ID NO: 115 - DNA, 264 bp, Streptococcus thermophilus
atggcttctaaagatttccacattgttgcagaaactggtattcacgcacgaccagctgctttgcttgttcaaacagcaagtaaatttgcttcagatatcactcttgaatacaaaggtaaagcagttaaccttaaatctatcatgggtgttatgagtcttggtgttggtcaaggtgctgacgtaactatttctgcagaaggtcctgacgctgatgatgcaattgcagcaatcgcagaaacaatgacaaaagaaggattggcataa

SEQ ID NO: 116 - protein, 87 aa, Streptococcus thermophilus
MASKDFHIVAETGIHARPAALLVQTASKFASDITLEYKGKAVNLKSIMGVMSLGVGQGADVTISAEGPDADDAIAAIAETMTKEGLA

SEQ ID NO: 117 - DNA, 264 bp, Streptococcus thermophilus
atggcttctaaagatttccacattgttgcagaaactggtattcacgcacgaccagctactttgcttgttcaaacagcaagtaaatttgcttcagatatcactcttgaatacaaaggtaaagcagttaaccttaaatctatcatgggtattatgagtcttggtgttggtcaaggtgctgacgtaactatttctgcagaaggtcctgacgctgatgatgcaattgcagcaatcgcagaaacaatgacaaaagaaggattggcataa

SEQ ID NO: 118 - protein, 87 aa, Streptococcus thermophilus
MASKDFHIVAETGIHARPATLLVQTASKFASDITLEYKGKAVNLKSIMGIMSLGVGQGADVTISAEGPDADDAIAAIAETMTKEGLA

SEQ ID NO: 119 - DNA, 264 bp, Streptococcus thermophilus
atggcttctaaaaatttccacattgttgcagaaactggtattcacgcacgaccagctactttgcttgttcaaacagcaagtaaatttgcttcagatatcactcttgaatacaaaggtaaagcagttaaccttaaatctatcatgggtgttatgagtcttggtgttggtcagggtgctgacgtaactattactgcagaaggtcctgacgctgatgatgcaatttcagcaatcgcagaaacaatgacaaaagaaggattggcataa

SEQ ID NO: 120 - protein, 87 aa, Streptococcus thermophilus
MASKNFHIVAETGIHARPATLLVQTASKFASDITLEYKGKAVNLKSIMGVMSLGVGQGADVTITAEGPDADDAISAIAETMTKEGLA

SEQ ID NO: 121 - DNA, 993 bp, Streptococcus thermophilus
atgggtatcggtattattattgccagccatggtaggttcgctgaaggaatccaccaatcaggctctatgatttttggggaccaagagaaagttcaagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaatccagatcgcaagattgctatcatcacaggacttaacttgccaatgctaatccaagcatacactgaacgtatgatggatgctaacgctactgtagagcaagttgctgctaatatcatcaaggaagctaagggtggtatcaaggcacttccagaagagctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcacttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagatttgtttgagcttatcaagaaagctaacgttcaataa

SEQ ID NO: 122 - protein, 330 aa, Streptococcus thermophilus
MGIGIIIASHGRFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKGGIKALPEELNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 123 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaacccagatcgcaagattgctatcatcacaggacttaacttgccaatgctaatccaagcatacactgaacgtatgatggatgctaacgctactgtagagcaagttgctgctaatatcatcaaggaagctaaggctggtatcaaggcacttccagaggcgctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcacttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 124 - protein, 330 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKAGIKALPEALNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 125 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaatccagatcgcaagattgctatcatcacaggacttaacttgccaatgctaatccaagcatacactgaacgtatgatggatgctaacgctactgtagagcaagttgctgctaatatcatcaaggaagctaagggtggtatcaaggcacttccagaagagctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcacttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagatttgtttgagcttatcaagaaagctaacgttcaataa

SEQ ID NO: 126 - protein, 330 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKGGIKALPEELNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 127 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaaagccattgcacaattcgatgttgatgatgaaattcttgttttggctgacctttggagtggttcaccatttaaccaagctagtcgaatcgctagggaaaatccagatcgcaagattgctatcatcacaggacttaacttgccaatgctaatccaagcatacactgaacgtatgatggatgctaacgctactgtagagcaagttgctgctaatatcatcaaggaagctaagggtggtatcaaggcacttccagaggagctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcacttgtcttgttcgaaactgttcaagacgtacttcgtgctgtcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 128 - protein, 330 aa, Streptococcus thermophilus
MGIGIIIASHGKFAEGIHQSGSMIFGDQEKVQVVTFMPSEGPDDLYAHFNKAIAQFDVDDEILVLADLWSGSPFNQASRIARENPDRKIAIITGLNLPMLIQAYTERMMDANATVEQVAANIIKEAKGGIKALPEELNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDVLRAVEGGVPIKELNVGSMAHSTGKTMVNNVLSMDKDDVACFEKLRDLGVEFDVRKVPNDSKKDLFELIKKANVQ

SEQ ID NO: 129 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaacccagatcgcaagattgctatcatcacaggacttaacttgccaatgctaatccaagcatacactgaacgtatgatggatgctaacgctactatagagcaagttgctgctaatatcatcaaggaagctaagggtggtatcaaggcacttccagaggcgctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtgttattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcacttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 130 - protein, 330 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATIEQVAANIIKEAKGGIKALPEALNPAEETTAAPVEAAAPQGAIPEGTVIGDGKLKINLARLDTRLLHGQVVTNWVPYSKADRVIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 131 - DNA, 993 bp, Streptococcus thermophilus
atgggtatcggtattattatcgccagccatggtaagttcgctgaaggaatccaccaatcaggctctatgatttttggggaccaagagaaagttcgagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaacccagatcgcaagattgctatcatcacaggacttaacttgccaatgctaatccaagcatacactgaacgtatgatggatgctaacgctactgtagagcaagttgctgctaatatcatcaaggaagctaaggctggtatcaaggcacttccagaggcgctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcgcttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 132 - protein, 330 aa, Streptococcus thermophilus
MGIGIIIASHGKFAEGIHQSGSMIFGDQEKVRVVTFMPSEGPDDLYAHFNNAIAQFDVDDEILVLADLWSGSPFNQASRIARENPDRKIAIITGLNLPMLIQAYTERMMDANATVEQVAANIIKEAKAGIKALPEALNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 133 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaacccagatcgcaagattgctatcatcacaggacttaacttgccaatgctaatccaagcatacactgaacgtatgatggatgctaacgctactgtagagcaagttgctgctaatatcatcaaggaagctaagggtggtatcaaggcacttccagaggcgctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcacttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 134 - protein, 330 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKGGIKALPEALNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 135 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaacccagatcgcaagattgctatcatcacaggacttaacttgccaatgctaatccaagcatacactgaacgtatgatggatgctaacgctactgtagagcaagttgctgctaatatcatcaaggaagctaaggctggtatcaaggcacttccagaggagctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcacttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 136 - protein, 330 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKAGIKALPEELNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 137 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaacccagatcgcaagattgctatcatcacaggacttaacttgccaatgctaatccaagcatacactgaacgtatgatggatgctaacgctactatagagcaagttgctgctaatatcatcaaggaagctaagggtggtatcaaggcacttccagaggcgctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcacttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 138 - protein, 330 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATIEQVAANIIKEAKGGIKALPEALNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 139 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaacccagatcgcaagattgctatcatcacaggacttaacttgccaatgctaatccaagcatacactgaacgtatgatggatgctaacgctactgtagagcaagttgttgctaatatcatcaaggaagctaagggtggtatcaaggcacttccagaggcgctaaatccagctgaggaaacaactgcagctcctgtagaagctgcagcacttcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcacttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 140 - protein, 330 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVVANIIKEAKGGIKALPEALNPAEETTAAPVEAAALQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 141 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaaagccattgcacaattcgatgttgatgatgaaattcttgttttggctgacctttggagtggttcaccatttaaccaagctagtcgaatcgctagggaaaatccagatcgcaagattgctatcatcacaggacttaacttgccaatgctaatccaagcatacactgaacgtatgatggatgctaacgctactgtagagcaagttgctgctaatatcatcaaggaagctaagggtggtatcaaggcacttccagaggagctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattagttgatgcttctaaagacccacgttttggaaatacacatgcacttgtcttgttcgaaactgttcaagacgtacttcgtgctgtcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 142 - protein, 330 aa, Streptococcus thermophilus
MGIGIIIASHGKFAEGIHQSGSMIFGDQEKVQVVTFMPSEGPDDLYAHFNKAIAQFDVDDEILVLADLWSGSPFNQASRIARENPDRKIAIITGLNLPMLIQAYTERMMDANATVEQVAANIIKEAKGGIKALPEELNPAEETTAAPVEAAAPQGAIPEGTVIGDGKLKINLARLDTRLLHGQVVTNWVPYSKADRIIVASDDVAKDELRKELIKQAAPNGIKVNVVPIQKLVDASKDPRFGNTHALVLFETVQDVLRAVEGGVPIKELNVGSMAHSTGKTMVNNVLSMDKDDVACFEKLRDLGVEFDVRKVPNDSKKDLFELIKKANVQ

SEQ ID NO: 143 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaacccagatcgcaagattgctatcatcacaggacttaacttgccaatgctaatccaagcatacactgaacgtatgatggatgctaacgctactgtagagcaagttgctgctaatatcatcaaggaagctaaggctggtatcaaggcacttccagaggcgctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgtttttccgattcaaaaattaattgatgcttctaaagacccacgttttggaaatacacatgcgcttgtcttgttcgaaactgttcaagacgcgcttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 144 - protein, 330 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKAGIKALPEALNPAEETTAAPVEAAAPQGAIPEGTVIGDGKLKINLARLDTRLLHGQVVTNWVPYSKADRIIVASDDVAKDELRKELIKQAAPNGIKVNVFPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 145 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaataacgccattgcacaattcgatgttgatgatgaaattcttgttttggctgacctttggagtggttcaccatttaaccaagctagtcgaatcgctagggaaaatccagatcgcaagattgctatcatcacaggacttaacttgccaatgctaatccaagcatacactgaacgtatgatggatgctaacgctactgtagagcaaattgctgctaatatcatcaaggaagctaagggtggtatcaaggcacttccagaggagctaaatccagctgaggaaacaactgcagctcctgtagaagctgcagcacctcaaggagctatccctgaaggaacagtcatcggagatggtaaactcaagattaacttggcacgtttggactcacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcacttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgtcgaatttgacgtccgtaaggttccaaacgattctaagaaagacttgtttgagcttatcaagaaagctaacgttcaataa

SEQ ID NO: 146 - protein, 330 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQIAANIIKEAKGGIKALPEELNPAEETTAAPVEAAAPQGAIPEGTVIGDGKLKINLARLDSRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 147 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaacccagatcgcaagattgctatcatcacaggacttaacttgccaatgctaatccaagcatacactgaacgtatgatggatgctaacgctactgtagagcaagttactgctaatatcatcaaggaagctaaggctggtatcaaggcacttccagaggcgctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcacttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 148 - protein, 330 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVTANIIKEAKAGIKALPEALNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 149 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaaagccattgcacaattcgatgttgatgatgaaattcttgttttggctgacctttggagtggttcaccatttaaccaagctagtcgaatcgctagggaaaatccagatcgcaagattgctatcatcacaggacttaacttgccaatgctaatccaagcatacactgaacgtatgatggatgctaacgctactgtagagcaagttgctgctaatatcatcaaggaagctaagggtggtatcaaggcacttccagaggagctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcgcttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 150 - protein, 330 aa, Streptococcus thermophilus
MGIGIIIASHGKFAEGIHQSGSMIFGDQEKVQVVTFMPSEGPDDLYAHFNKAIAQFDVDDEILVLADLWSGSPFNQASRIARENPDRKIAIITGLNLPMLIQAYTERMMDANATVEQVAANIIKEAKGGIKALPEELNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 151 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaacccagatcgcaagattgctatcatcacaggacttaacttgccaatgctaatccaagcatacactgaacgtatgatggatgctaacgctactgtagagcaagttgctgctaatatcatcaaggaagctaaggctggtatcaaggcacttccagaggcgctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcacttgtcttgttcgaaactgttcaagacgtacttcgtgctgtcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 152 - protein, 330 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKAGIKALPEALNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDVLRAVEGGVPIKELNVGSMAHSTGKTMVNNVLSMDKDDVACFEKLRDLGVEFDVRKVPNDSKKDLFELIKKANVQ

SEQ ID NO: 153 - DNA, 993 bp, Streptococcus thermophilus
atgggtatcggtattattattgccagccatggtaagttcgctgaaggaatccaccaatcaggctctatgatttttggggaccaagagaaagttcaagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaacccagatcgcaagattgctatcatcacaggacttaacttaccaatgctaatccaagcatacactgaacgtatgatggatgctaacgctactgtagagcaagttgctgctaatatcatcaaggaagctaaggcaggtatcaaggcacttccagaggcgctaaatccagctgaggaaacaactgcagctcctgtagaagctacagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcacttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgttgaatttgacgtccgtaaggttccaaacgattctaagaaagacttgtttgagcttatcaagaaagctaacgttcaataa

SEQ ID NO: 154 - protein, 330 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKAGIKALPEALNPAEETTAAPVEATAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGVEFDVRKVPNDSKKDLFELIKKANVQ

SEQ ID NO: 155 - DNA, 993 bp, Streptococcus thermophilus
atgggtatcggtattattattgccagccatggtaggttcgctgaaggaatccaccaatcaggctctatgatttttggggaccaagagaaagttcaagttgtgactttcatgccaagtgaaggtcctgatgatttgtacgctcacttcaacaacgccattgcacaattcgatgttgatgatgaaattcttgttttggctgacctttggagtggttcaccatttaaccaagctagtcgaatcgctagggaaaatccagatcgcaagattgctatcatcacaggacttaacttgccaatgctaatccaagcatacactgaacgtatgatggatgctaacgctactgtagagcaagttgctgctaatatcatcaaggaagctaagggtggtatcaaggcacttccagaagagctaaatccagctgaggaaacaactgcagctcctgtagaagctgcagcacctcaaggagctatccctgaaggaacagtcatcggagatggtaaactcaagattaacttggcacgtttggacacacgtctcttgcatggtcaagtagtaactaactgggtaccttattctaaagcagaccgtattattgttgcttcggatgacgttgccaaagatgagcttcgtaaggaattgatcaaacaggctgcaccaaacggtattaaagtaaacgttgttccgattcaaaaattaattgatgcttctaaagacccacgttttggaaatacacatgcgcttgtcttgttcgaaactgttcaagacgcacttcgtgctatcgaaggtggcgtgccaataaaagaacttaacgttggttctatggctcactcaactggtaaaacaatggttaacaacgttttgtctatggataaagatgatgttgcttgttttgaaaaattacgtgaccttggcgtttaatttgacgtccgtaaggttccaaacgattctaagaaagatttgtttgagcttatcaagaaagctaacgttcaataa

SEQ ID NO: 156 - protein, 305 aa, Streptococcus thermophilus
MGIGIIIASHGRFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKGGIKALPEELNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGV

SEQ ID NO: 157 - protein, 305 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKAGIKALPEALNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGV

SEQ ID NO: 158 - protein, 305 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKGGIKALPEELNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGV

SEQ ID NO: 159 - protein, 305 aa, Streptococcus thermophilus
MGIGIIIASHGKFAEGIHQSGSMIFGDQEKVQVVTFMPSEGPDDLYAHFNKAIAQFDVDDEILVLADLWSGSPFNQASRIARENPDRKIAIITGLNLPMLIQAYTERMMDANATVEQVAANIIKEAKGGIKALPEELNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDVLRAVEGGVPIKELNVGSMAHSTGKTMVNNVLSMDKDDVACFEKLRDLGV

SEQ ID NO: 160 - protein, 305 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATIEQVAANIIKEAKGGIKALPEALNPAEETTAAPVEAAAPQGAIPEGTVIGDGKLKINLARLDTRLLHGQVVTNWVPYSKADRVIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGV

SEQ ID NO: 161 - protein, 305 aa, Streptococcus thermophilus
MGIGIIIASHGKFAEGIHQSGSMIFGDQEKVRVVTFMPSEGPDDLYAHFNNAIAQFDVDDEILVLADLWSGSPFNQASRIARENPDRKIAIITGLNLPMLIQAYTERMMDANATVEQVAANIIKEAKAGIKALPEALNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGV

SEQ ID NO: 162 - protein, 305 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKGGIKALPEALNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGV

SEQ ID NO: 163 - protein, 305 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKAGIKALPEELNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGV

SEQ ID NO: 164 - protein, 305 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATIEQVAANIIKEAKGGIKALPEALNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGV

SEQ ID NO: 165 - protein, 305 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVVANIIKEAKGGIKALPEALNPAEETTAAPVEAAALQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGV

SEQ ID NO: 166 - protein, 305 aa, Streptococcus thermophilus
MGIGIIIASHGKFAEGIHQSGSMIFGDQEKVQVVTFMPSEGPDDLYAHFNKAIAQFDVDDEILVLADLWSGSPFNQASRIARENPDRKIAIITGLNLPMLIQAYTERMMDANATVEQVAANIIKEAKGGIKALPEELNPAEETTAAPVEAAAPQGAIPEGTVIGDGKLKINLARLDTRLLHGQVVTNWVPYSKADRIIVASDDVAKDELRKELIKQAAPNGIKVNVVPIQKLVDASKDPRFGNTHALVLFETVQDVLRAVEGGVPIKELNVGSMAHSTGKTMVNNVLSMDKDDVACFEKLRDLGV

SEQ ID NO: 167 - protein, 305 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKAGIKALPEALNPAEETTAAPVEAAAPQGAIPEGTVIGDGKLKINLARLDTRLLHGQVVTNWVPYSKADRIIVASDDVAKDELRKELIKQAAPNGIKVNVFPIQKLIDASKDPRFGNTHALVLFETVQDALRAIEGGVPIKELNVGSMAHSTGKTMVNNVLSMDKDDVACFEKLRDLGV

SEQ ID NO: 168 - protein, 305 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQIAANIIKEAKGGIKALPEELNPAEETTAAPVEAAAPQGAIPEGTVIGDGKLKINLARLDSRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGV

SEQ ID NO: 169 - protein, 305 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVTANIIKEAKAGIKALPEALNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGV

SEQ ID NO: 170 - protein, 305 aa, Streptococcus thermophilus
MGIGIIIASHGKFAEGIHQSGSMIFGDQEKVQVVTFMPSEGPDDLYAHFNKAIAQFDVDDEILVLADLWSGSPFNQASRIARENPDRKIAIITGLNLPMLIQAYTERMMDANATVEQVAANIIKEAKGGIKALPEELNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGV

SEQ ID NO: 171 - protein, 305 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKAGIKALPEALNPAEETTAAPVEAAAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDVLRAVEGGVPIKELNVGSMAHSTGKTMVNNVLSMDKDDVACFEKLRDLGV

SEQ ID NO: 172 - protein, 305 aa, Streptococcus thermophilus
MGIGIIIASHGKFAEGIHQSGSMIFGDQEKVQVVTFMPSEGPDDLYAHFNNAIAQFDVDDEILVLADLWSGSPFNQASRIARENPDRKIAIITGLNLPMLIQAYTERMMDANATVEQVAANIIKEAKAGIKALPEALNPAEETTAAPVEATAPQGAIPEGTVIGDGKLKINLARLDTRLLHGQVVTNWVPYSKADRIIVASDDVAKDELRKELIKQAAPNGIKVNVVPIQKLIDASKDPRFGNTHALVLFETVQDALRAIEGGVPIKELNVGSMAHSTGKTMVNNVLSMDKDDVACFEKLRDLGV

SEQ ID NO: 173 - DNA, 828 bp, Streptococcus thermophilus
atgtcagatatgtcaattatttctgcgattttggtcgtagctgttgccttccttgctggtcttgaaagtatccttgaccaattccaattccaccaaccacttgttgcatgtaccctcatcggtgctgccacaggtaacctcactgcaggtatcatgcttggtggttctcttcaaatgattacccttgcttgggcaaacatcggtgctgccgtagctcctgacgttgcccttgcatctgttgccgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctcgctctccttcttcaaggtttgcgtattgctgtgccagcagcccttcttcttgccatcccggcccaatctgttcaacatgcccttggcttgatgcctgactggctcacccatggtttggttgtcggtggtggtatggtcgtagccgttggttacgccatgattatcaatatgatggctactcgtgaagtttggccattcttcgccattggttttgctttggcagcaattagccaattgacacttatcgctcttagtaccattggtgttgccatcgccttcatctacctcaacctttctaaacaaggtggcggaaatggtggcggaaatggtggcggaacttcatctggttcaggcgacccaatcggcgatatcttggaagactactag

SEQ ID NO: 174 - protein, 275 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLALLLQGLRIAVPAALLLAIPAQSVQHALGLMPDWLTHGLVVGGGMVVAVGYAMIINMMATREVWPFFAIGFALAAISQLTLIALSTIGVAIAFIYLNLSKQGGGNGGGNGGGTSSGSGDPIGDILEDY

SEQ ID NO: 175 - DNA, 828 bp, Streptococcus thermophilus
atgtcagatatgtcaattatttctgcgattttggtcgtagctgttgccttccttgctggtcttgaaagtatccttgaccaattccaattccaccaaccacttgttgcatgtaccctcatcggtgctgccacaggtaacctcactgcaggtatcatgcttggtggttctcttcaaatgattacccttgcttgggcaaacatcggtgctgccgtagctcctgacgttgcccttgcatctgttgccgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctctctctccttcttcaaggtttgcgtattgctgtgccagcagcccttcttcttgccatcccggcccaatctgttcaacatgcccttggcttgatgcctgactggctcacccatggtttggttgtcggtggtggtatggtcgtagccgttggttacgccatgattatcaatatgatggctactcgtgaagtttggccattcttcgccatcggttttgctttggcagcaattagccaattgacacttatcgctcttagtaccattggtgttgccatcgccttcatctacctcaacctttctaaacaaggtggcggaaatggtggcggaaatggtggcggaacttcatctggttcaggcgacccaatcggcgatatcttggaagactactag

SEQ ID NO: 176 - protein, 275 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLSLLLQGLRIAVPAALLLAIPAQSVQHALGLMPDWLTHGLVVGGGMVVAVGYAMIINMMATREVWPFFAIGFALAAISQLTLIALSTIGVAIAFIYLNLSKQGGGNGGGNGGGTSSGSGDPIGDILEDY

SEQ ID NO: 177 - DNA, 828 bp, Streptococcus thermophilus
atgtcagatatgtcaattatttctgcgattttggtcgtagctgttgccttccttgctggtcttgaaggtatccttgaccaattccaattccaccaaccacttgttgcatgtaccctcatcggtgctgccacaggtaacctcactgcaggtatcatgcttggtggttctcttcaaatgattacccttgcttgggcaaacatcggtgctgccgtagctcctgacgttgcccttgcatctgttgctgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctcgctctccttcttcaaggtttgcgtattgctgtgccagcagcccttcttcttgccatcccggcccaatctgttcaacatgcccttggcttgatgcctgactggctcacccatggtttggttgtcggtggtggtatggtcgtagccgttggttacgccatgattatcaatatgatggctactcgtgaagtttggccattcttcgccatcggttttgctttggcagcaattagccaattgacacttatcgctcttagtaccattggtgttgccatcgccttcatctacctcaacctttctaaacaaggtggcggaaatggtggcggaaatggtggcggaacttcatctggttcaggcgacccaatcggcgatatcttggaagactactag

SEQ ID NO: 178 - protein, 275 aa, Streptococcus thermophilus
MSDMSIISAILVVAVAFLAGLEGILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLALLLQGLRIAVPAALLLAIPAQSVQHALGLMPDWLTHGLVVGGGMVVAVGYAMIINMMATREVWPFFAIGFALAAISQLTLIALSTIGVAIAFIYLNLSKQGGGNGGGNGGGTSSGSGDPIGDILEDY

SEQ ID NO: 179 - DNA, 828 bp, Streptococcus thermophilus
atgtcagatatgtcaattatttctgcgattttggtcgtagctgttgccttccttgctggtcttgaaagtatccttgaccaattccaattccaccaaccacttgttgcatgtaccctcatcggtgctgccacaggtaatctcactgcaggtatcatgcttggtggttctcttcaaatgattacccttgcttgggcaaacatcggtgctgccgtagctcctgacgttgcccttgcatctgttgccgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctctctctccttcttcaaggtttgcgtattgctgtgccagcagcccttcttcttgccatcccggcccaatctgttcaacatgcccttggcttgatgcctgactggctcacccatggtttggttgtcggtggtggtatggtcgtagccgttggttacgccatgattatcaatatgatggctactcgtgaagtttggccattcttcgccattggttttgctttggcagcaattagccaattgacacttatcgctctttgtgccattggtgttgccatcgccttcatctacctcaacctttctaaacaaggtggcggaaatggcggcggaaatggtggcggaacttcatctggttcaggcgacccaatcggcgatatcttggaagactactag

SEQ ID NO: 180 - protein, 275 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLSLLLQGLRIAVPAALLLAIPAQSVQHALGLMPDWLTHGLVVGGGMVVAVGYAMIINMMATREVWPFFAIGFALAAISQLTLIALCAIGVAIAFIYLNLSKQGGGNGGGNGGGTSSGSGDPIGDILEDY

SEQ ID NO: 181 - DNA, 828 bp, Streptococcus thermophilus
atgtcagatatgtcaattatttctgcgattttggtcgtagctgttgccttccttgctggtcttgaaagtatccttgaccaattccaattccaccaaccacttgttgcatgtaccctcatcggtgctgccacaggtaacctcactgcaggtatcatgcttggtggttctcttcaaatgattacccttgcttgggcaaacatcggtgctgccgtagctcctgacgttgcccttgcatctgttgccgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctctctctccttcttcaaggtttgcgtattgctgtgccagcagcccttcttcttgccatcccggcccaatctgttcaacatgcccttggcttgatgcctgactggctcacccatggtttggttgtcggtagtggtatggtcgtagccgttggttacgccatgattatcaatatgatggctactcgtgaagtttggccattcttcgccattggttttgctttggcagcaattagccaattgacacttatcgctctttgtgccattggtgttgccatcgccttcatctacctcaacctttctaaacaaggtggcggaaatggtggcggaaatggtggcggaacttcatctggttcaggcgacccaatcggcgatatcttggaagactactag

SEQ ID NO: 182 - protein, 275 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLSLLLQGLRIAVPAALLLAIPAQSVQHALGLMPDWLTHGLVVGSGMVVAVGYAMIINMMATREVWPFFAIGFALAAISQLTLIALCAIGVAIAFIYLNLSKQGGGNGGGNGGGTSSGSGDPIGDILEDY

SEQ ID NO: 183 - DNA, 828 bp, Streptococcus thermophilus
atgtcagatatgtcaattatttctgcgattttggtcgtagctgttgccttccttgctggtcttgaaagtatccttgaccaattccaattccaccaaccacttgttgcatgtaccctcatcggtgctgccacaggtaacctcactgcaggtatcatgcttggtggttctcttcaaatgattacccttgcttgggcaaacatcggtgctgccgtagctcctgacgttgcccttgcatctgttgccgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctcgctctccttcttcaaggtttgcgtattgctgtgccagcagcccttcttcttgccatcccggcccaatctgttcaacatgcccttggcttgatgcctgactggctcacccatggtttggttgtcggtggtggtatggtcgtagccgttggttacgccatgattatcaatatgatggctactcgtgaagtttggccattcttcgccatcggttttgctttggcagcaattagccaattgacacttatcgctcttggtaccattggtgttgccatcgccttcatctacctcaacctttctaaacaaggtggcggaaatggtggcggaaatggtggcggaacttcatctggttcaggcgacccaatcggcgatatcttggaagactactag

SEQ ID NO: 184 - protein, 275 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLALLLQGLRIAVPAALLLAIPAQSVQHALGLMPDWLTHGLVVGGGMVVAVGYAMIINMMATREVWPFFAIGFALAAISQLTLIALGTIGVAIAFIYLNLSKQGGGNGGGNGGGTSSGSGDPIGDILEDY

SEQ ID NO: 185 - DNA, 828 bp, Streptococcus thermophilus
atgtcagatatgtcaattatttctgcgattttggtcgtagctgttgccttccttgctggtcttgaaggtatccttgaccaattccaattccaccaaccacttgttgcatgtaccctcatcggtgctgccacaggtaacctcactgcaggtatcatgcttggtggttctcttcaaatgattacccttgcttgggcaaacatcggtgctgccgtagctcctgacgttgcccttgcatctgttgctgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctcgctctccttcttcaaggtttgcgtattgctgtgccagcagcccttcttcttgccatcccggcccaatctgttcaacatgcccttggcttgatgcctgactggctcacccatggtttggttgtcggtggtggtatggtcgtagccgttggttacgccatgattatcaatatgatggctactcgtgaagtttggccattcttcgccatcggttttgctttggcagcaattagccaattgacacttatcgctcttggtaccattggtgttgccatcgccttcatctacctcaacctttctaaacaaggtggcggaaatggtggcggaaatggtggcggaacttcatctggttcaggcgacccaatcggcgatatcttggaagactactag

SEQ ID NO: 186 - protein, 275 aa, Streptococcus thermophilus
MSDMSIISAILVVAVAFLAGLEGILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLALLLQGLRIAVPAALLLAIPAQSVQHALGLMPDWLTHGLVVGGGMVVAVGYAMIINMMATREVWPFFAIGFALAAISQLTLIALGTIGVAIAFIYLNLSKQGGGNGGGNGGGTSSGSGDPIGDILEDY

SEQ ID NO: 187 - DNA, 828 bp, Streptococcus thermophilus
atgtcagatatgtcaattatttctgcgattttggtcgtagctgttgccttccttgctggtcttgaaagtatccttgaccaattccaattccaccaaccacttgttgcatgtactctcatcggtgctgccacaggtaacctcactgcaggtatcatgcttggtggttctcttcaaatgattacccttgcttgggcaaacatcggtgctgccgtagctcctgacgttgcccttgcatctgttgccgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctctctctccttcttcaaggtttgcgtattgctgtgccagcagcccttcttcttgccatcccggcccaatctgttcaacatgcccttggcttgatgcctgactggctcacccatggtttggttgtcggtggtggtatggtcgtagccgttggttacgccatgattatcaatatgatggctactcgtgaagtttggccattcttcgccatcggttttgctttggcagcaattagccaattgacacttatcgctcttggtgccattggtgttgccatcgccttcatctacctcaacctttctaaacaaggtggcggaaatggtggcggaaatggtggcggaacttcatctggttcaggcgacccaatcggcgatatcttggaagactactag

SEQ ID NO: 188 - protein, 275 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLSLLLQGLRIAVPAALLLAIPAQSVQHALGLMPDWLTHGLVVGGGMVVAVGYAMIINMMATREVWPFFAIGFALAAISQLTLIALGAIGVAIAFIYLNLSKQGGGNGGGNGGGTSSGSGDPIGDILEDY

SEQ ID NO: 189 - DNA, 828 bp, Streptococcus thermophilus
atgtcagatatgtcaattatttctgcgattttggtcgtagctgttgccttccttgctggtcttgaaggtatccttgaccaattccaattccaccaaccacttgttgcatataccctcatcggtgctgccacaggtaacctcactgcaggtatcatgcttggtggttctcttcaaatgattacccttgcttgggcaaacatcggtgctgccgtagctcctgacgttgcccttgcatctgttgctgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctcgctctccttcttcaaggtttgcgtattgctgtgccagcagcccttcttcttgccatcccggcccaatctgttcaacatgcccttggcttgatgcctgactggctcacccatggtttggttgtcggtggtggtatggtcgtagccgttggttacgccatgattatcaatatgatggctactcgtgaagtttggccattcttcgccatcggttttgctttggcagcaattagccaattgacacttatcgctcttagtaccattggtgttgccatcgccttcatctacctcaacctttctaaacaaggtggcggaaatggtggcggaaatggtggcggaacttcatctggttcaggcgacccaatcggcgatatcttggaagactactag

SEQ ID NO: 190 - protein, 275 aa, Streptococcus thermophilus
MSDMSIISAILVVAVAFLAGLEGILDQFQFHQPLVAYTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLALLLQGLRIAVPAALLLAIPAQSVQHALGLMPDWLTHGLVVGGGMVVAVGYAMIINMMATREVWPFFAIGFALAAISQLTLIALSTIGVAIAFIYLNLSKQGGGNGGGNGGGTSSGSGDPIGDILEDY

SEQ ID NO: 191 - DNA, 828 bp, Streptococcus thermophilus
atgtcagatatgtcaattatttctgcgattttggtcgtagctgttgccttccttgctggtcttgaaagtatccttgaccaattccaattccaccaaccacttgttgcatgtaccctcatcggtgctgccacaggtaacctcactgcaggtatcatgcttggtggttctcttcaaatgattacccttgcttgggcaaacatcggtgctgccgtagctcctgacgttgcccttgcatctgttgccgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctcgctctccttcttcaaggtttgcgtattgctgtgccagcagcccttcttcttgccatcccggcccaatctgttcaacatgcccttggcttgatgcctgactggctcacccatggtttggttgtcggtagtggtatggtcgtagccgttggttacgccatgattatcaatatgatggctactcgtgaagtttggccattcttcgccatcggttttgctttggcagcaattagccaattgacacttatcgctcttggtgccattggtgttgccatcgccttcatctacctcaacctttctaaacaaggtggcggaaatagtggcggaaatggtggcggaacttcatctggttcaggcgacccaatcggcgatatcttggaagactactag

SEQ ID NO: 192 - protein, 275 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLALLLQGLRIAVPAALLLAIPAQSVQHALGLMPDWLTHGLVVGSGMVVAVGYAMIINMMATREVWPFFAIGFALAAISQLTLIALGAIGVAIAFIYLNLSKQGGGNSGGNGGGTSSGSGDPIGDILEDY

SEQ ID NO: 193 - DNA, 828 bp, Streptococcus thermophilus
atgtcagatatgtcaattatttctgcgattttggtcgtagctgttgccttccttgctggtcttgaaagtatccttgaccaattccaattccaccaaccacttgttgcatgtaccctcatcggtgctgccacaggtaacctcactgcaggtatcatgcttggtggttctcttcaaatgattacccttgcttgggcaaacatcggtgctgccgtagctcctgacgttgcccttgcatctgttgccgctgccatcattttggttaaaggtggtaaatttacagctgaaggtatcggtgttgcgattgcaatagctatcctgcttgcagttgcaggtctcttcctaactatgcctgttcgtacagcatctattacctttgttcatgctgcagataaagctgcagaacacggaaacatcgctggtgttgaacgtgcatactacctctctctccttcttcaaggtttgcgtattgctgtgccagcagcccttcttcttgccatcccggcccaatctgttcaacatgcccttggcttgatgcctgactggctcacccatggtttggttgtcggtggtggtatggtcgtagccgttggttacgccatgattatcaatatgatggctactcgtgaagtttggccattcttcgccattggttttgctttggcagcaattagccaattgacacttatcgctctttgtgccattggtgttgccatcgccttcatctacctcaacctttctaaacaaggtggcggaaatggtggcggaaatggtggcggaacttcatctggttcaggcgacccaatcggcgatatcttggaagactactag

SEQ ID NO: 194 - protein, 275 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASITFVHAADKAAEHGNIAGVERAYYLSLLLQGLRIAVPAALLLAIPAQSVQHALGLMPDWLTHGLVVGGGMVVAVGYAMIINMMATREVWPFFAIGFALAAISQLTLIALCAIGVAIAFIYLNLSKQGGGNGGGNGGGTSSGSGDPIGDILEDY

SEQ ID NO: 195 - DNA, 828 bp, Streptococcus thermophilus
atgtcagatatgtcaattatttctgcgattttggtcgtagctgttgccttccttgctggtcttgaaagtatccttgaccaattccaattccaccaaccacttgttgcatgtaccctcatcggtgctgccacaggtaacctcactgcaggtatcatgcttggtggttctcttcaaatgattacccttgcttgggcaaacatcggtgctgccgtagctcctgacgttgcccttgcatctgttgccgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctctctctccttcttcaaggtttgcgtattgctgtgccagcagcccttcttcttgccatcccggcccaatctgttcaacatgcccttggcttgatgcctgactggctcacccatggtttggttgtcggtggtggtatggtcgtagccgttggttacgccatgattatcaatatgatggctactcgtgaagtttggccattcttcgccattggttttgctttggcagcaattagccaattgacacttatcgctcttggtgccattggtgttgccatcgccttcatctacctcaacctttctaaacatggtggcggaaatggtggcggaaatggtggcggaacttcatctggttcaggcgacccaatcggcgatatcttggaagactactag

SEQ ID NO: 196 - protein, 275 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLSLLLQGLRIAVPAALLLAIPAQSVQHALGLMPDWLTHGLVVGGGMVVAVGYAMIINMMATREVWPFFAIGFALAAISQLTLIALGAIGVAIAFIYLNLSKHGGGNGGGNGGGTSSGSGDPIGDILEDY

SEQ ID NO: 197 - DNA, 828 bp, Streptococcus thermophilus
atgtcagatatgtcaattatttctgcgattttggtcgtagctgttaccttccttgctggtcttgaaagtatccttgaccaattccaattccaccaaccacttgttgcatgtaccctcatcggtgctgccacaggtaacctcactgcaggtatcatgcttggtggttctcttcaaatgattacccttgcttgggcaaacatcggtgctgccgtagctcctgacgttgcccttgcatctgttgccgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctcgctctccttcttcaaggtttgcgtattgctgtgccagcagcccttcttcttgccatcccggcccaatctgttcaacatgcccttggcttgatgcctgactggctcacccatggtttggttgtcggtagtggtatggtcgtagccgttggttacgccatgattatcaatatgatggctactcgtgaagtttggccattcttcgccatcggttttgctttggcagcaattagccaattgacacttatcgctcttggtgccattggtgttgccatcgccttcatctacctcaacctttctaaacaaggtggtggaaatggtggcggaaatggtggcggaacttcatctggttcaggcgacccaatcggcgatatcttggaagactactag

SEQ ID NO: 198 - protein, 275 aa, Streptococcus thermophilus
MSDMSIISAILVVAVTFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLALLLQGLRIAVPAALLLAIPAQSVQHALGLMPDWLTHGLVVGSGMVVAVGYAMIINMMATREVWPFFAIGFALAAISQLTLIALGAIGVAIAFIYLNLSKQGGGNGGGNGGGTSSGSGDPIGDILEDY

SEQ ID NO: 199 - DNA, 828 bp, Streptococcus thermophilus
atgtcagatatgtcaattatttctgcgattttggtcgtagctgttgccttccttgctggtcttgaaagtatccttgaccaattccaattccaccaaccacttgttgcatgtaccctcatcggtgctgccacaggtaacctcactgcaggtatcatgcttggtggttctcttcaaatgattacccttgcttgggcaaacatcggtgctgccgtagctcctgacgttgcccttgcatctgttgccgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctcgctctccttcttcaaggtttgcgtattgctgtgccagcagcccttcttcttgccatcccggcccaatctgttcaacatgcccttggcttgatgcctgactggctcacccatggtttggttgtcggtagtggtatggtcgtagccgttggttacgccatgattatcaatatgatggctactcgtgaagtttggccattcttcgccatcggttttgctttggcagcaattagccaattgacacttatcgctcttggtgccattggtgttgccatcgccttcatctacctcaacctttctaaacaaggtggcggaaatggtggcggaaatggtggcggaacttcatctggttcaggcgacccaatcggcgatatcttggaagactactag

SEQ ID NO: 200 - protein, 275 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLALLLQGLRIAVPAALLLAIPAQSVQHALGLMPDWLTHGLVVGSGMVVAVGYAMIINMMATREVWPFFAIGFALAAISQLTLIALGAIGVAIAFIYLNLSKQGGGNGGGNGGGTSSGSGDPIGDILEDY

SEQ ID NO: 201 - DNA, 828 bp, Streptococcus thermophilus
atgtcagatatgtcaattatttctgcgattttggtcgtagctgttgccttccttgctggtcttgaaagtatccttgaccaattccaattccaccaaccacttgttgcatgtaccctcatcggtgctgccacaggtaacctcactgcaggtatcatgcttggtggttctcttcaaatgattacccttgcttgggcaaacatcggtgctgccgtagctcctgacgttgcccttgcatctgttgccgctgccatcattttggttaaaggtggtaaatttacagctgaaggtatcggtgttgcgattgcaatagctatcctgcttgcagttgcaggtctcttcctaactatgcctgttcgtacagcatctattgcctttgttcatgctgcagataaagctgcagaacacggaaacatcgctggtgttgaacgtgcatactacctcgctctccttcttcaaggtttgcgtattgctgtgccagcagcccttcttcttgccatcccggcccaatctgttcaacatgcccttggcttgatgcctgactggctcacccatggtttggttgtcggtggtggtatggtcgtagccgttggttacgccatgattatcaatatgatggctactcgttaagtttggccattcttcgccattggttttgctttggcagcaattagccaattgacacttatcgctcttagtaccattggtgttgccatcgccttcatctacctcaacctttctaaacaaggtggcggaaatggtggcggaaatggtggcggaacttcatctggttcaggcgacccaatcggcgatatcttggaagactactag

SEQ ID NO: 202 - protein, 208 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLALLLQGLRIAVPAALLLAIPAQSVQHALGLMPDWLTHGLVVGGGMVVAVGYAMIINMMATR

SEQ ID NO: 203 - protein, 208 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLSLLLQGLRIAVPAALLLAIPAQSVQHALGLMPDWLTHGLVVGGGMVVAVGYAMIINMMATR

SEQ ID NO: 204 - protein, 208 aa, Streptococcus thermophilus
MSDMSIISAILVVAVAFLAGLEGILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLALLLQGLRIAVPAALLLAIPAQSVQHALGLMPDWLTHGLVVGGGMVVAVGYAMIINMMATR

SEQ ID NO: 205 - protein, 208 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLSLLLQGLRIAVPAALLLAIPAQSVQHALGLMPDWLTHGLVVGSGMVVAVGYAMIINMMATR

SEQ ID NO: 206 - protein, 208 aa, Streptococcus thermophilus
MSDMSIISAILVVAVAFLAGLEGILDQFQFHQPLVAYTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLALLLQGLRIAVPAALLLAIPAQSVQHALGLMPDWLTHGLVVGGGMVVAVGYAMIINMMATR

SEQ ID NO: 207 - protein, 208 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLALLLQGLRIAVPAALLLAIPAQSVQHALGLMPDWLTHGLVVGSGMVVAVGYAMIINMMATR

SEQ ID NO: 208 - protein, 208 aa, Streptococcus thermophilus
MSDMSIISAILVVAVAFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASITFVHAADKAAEHGNIAGVERAYYLSLLLQGLRIAVPAALLLAIPAQSVQHALGLMPDWLTHGLVVGGGMVVAVGYAMIINMMATR

SEQ ID NO: 209 - protein, 208 aa, Streptococcus thermophilus
MSDMSIISAILVVAVTFLAGLESILDQFQFHQPLVACTLIGAATGNLTAGIMLGGSLQMITLAWANIGAAVAPDVALASVAAAIILVKGGKFTAEGIGVAIAIAILLAVAGLFLTMPVRTASIAFVHAADKAAEHGNIAGVERAYYLALLLQGLRIAVPAALLLAIPAQSVQHALGLMPDWLTHGLVVGSGMVVAVGYAMIINMMATR

SEQ ID NO: 210 - DNA, 912 bp, Streptococcus thermophilus
atggctgaaaaaattcaattatctcaagcggatcgtaaaaaggtttggtggcgctcacaattcttgcaaggtgcatggaactatgaacgtatgcaaaacttgggttgggcttactcactcattcctgctatcaaaaaactttatactaacaaagaggaccaagccgcagctcttaaacgtcacttggaattcttcaacactcacccttacgtagctgctcctatcataggggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgcccttggtgcatcattggcacaagctggtaacattgctggtccacttatcttcttcattggttggaaccttatccgcatggccttcttgtggtacactcaagaacttggttacaaagcaggttcagaaatcactaaagacatatctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgaccaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 211 - protein, 303 aa, Streptococcus thermophilus
MAEKIQLSQADRKKVWWRSQFLQGAWNYERMQNLGWAYSLIPAIKKLYTNKEDQAAALKRHLEFFNTHPYVAAPIIGVTLALEEEKANGTEIEDAAIQGVKIGMMGPLAGIGDPVFWFTIRPILGALGASLAQAGNIAGPLIFFIGWNLIRMAFLWYTQELGYKAGSEITKDISGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 212 - DNA, 912 bp, Streptococcus thermophilus
atggctgaaaaaattcaattatctcaagcggatcgtaaaaaggtttggtggcgctcacaattcttgcaaggttcatggaactatgaacgtatgcaaaacttgggttgggcttactcactcattcctgctatcaaaaaactttatactaacaaagaggaccaagccgcagctcttaaacgtcacttgaaattcttcaacactcacccttacgtagctgctcctatcatgggggttaccttagctcttgaagaagaaaaagctaatggtactgaaatcgaagatgcggctatccaaggggttaaaatcggtatgatgggtccacttgccggtatcggtgaccctgttttctggttcacaattcgtccaattcttggtgccattggtgcttcattggcacaagctggtaacattgctggtccacttatcttcttcattggttggaaccttatccgcatggccttcttgtggtacactcaagaacttggttacaaagcaggttcagaaatcactaaagacatgtctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgatcaactaaaaactattcttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 213 - protein, 303 aa, Streptococcus thermophilus
MAEKIQLSQADRKKVWWRSQFLQGSWNYERMQNLGWAYSLIPAIKKLYTNKEDQAAALKRHLKFFNTHPYVAAPIMGVTLALEEEKANGTEIEDAAIQGVKIGMMGPLAGIGDPVFWFTIRPILGAIGASLAQAGNIAGPLIFFIGWNLIRMAFLWYTQELGYKAGSEITKDMSGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 214 - DNA, 912 bp, Streptococcus thermophilus
atggctgaaaaaattcaattatctcaagcggatcgtaaaaaggtttggtggcgctcacaattcttgcaaggtgcatggaactatgaacgtatgcaaaacttgggttgggcttactcactcattcctgctatcaaaaaactttatactaacaaagaggaccaagccgcagctcttaaacgtcacttggaattcttcaacactcacccttacgtagctgctcctatcataggggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgcccttggtgcatcattggcacaagctggtaacattgctggtccacttatcttcttcattggttggaaccttatccgcatggccttcttgtggtacactcaagaacttggttacaaagcaggttcagaaatcactaaagacatatctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgaccaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattattgcaagcttcttcggaatcatgtaa

SEQ ID NO: 215 - protein, 303 aa, Streptococcus thermophilus
MAEKIQLSQADRKKVWWRSQFLQGAWNYERMQNLGWAYSLIPAIKKLYTNKEDQAAALKRHLEFFNTHPYVAAPIIGVTLALEEEKANGTEIEDAAIQGVKIGMMGPLAGIGDPVFWFTIRPILGALGASLAQAGNIAGPLIFFIGWNLIRMAFLWYTQELGYKAGSEITKDISGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIIASFFGIM

SEQ ID NO: 216 - DNA, 912 bp, Streptococcus thermophilus
atgtctgaaaaaattcaattatctcaagcggatcgtaaaaaggtttggtggcgctcacaattcttgcaaggttcatggaactatgaacgtatgcaaaacttgggttgggcttactcactcattcctgctatcaaaaaactttatactaacaaagaggaccaagccgcagctcttaaacgtcacttggaattcttcaacactcacccttacgtagctgctcctatcatgggggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgcccttggtgcatcattggcacaatctggtaacattgctggtccacttatcttcttcattggttggaaccttatccgcatgaccttcttgtggtacactcaagaacttggttacaaagcaggttcagaaatcactaaagacatgtctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgaccaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 217 - protein, 303 aa, Streptococcus thermophilus
MSEKIQLSQADRKKVWWRSQFLQGSWNYERMQNLGWAYSLIPAIKKLYTNKEDQAAALKRHLEFFNTHPYVAAPIMGVTLALEEEKANGTEIEDAAIQGVKIGMMGPLAGIGDPVFWFTIRPILGALGASLAQSGNIAGPLIFFIGWNLIRMTFLWYTQELGYKAGSEITKDMSGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 218 - DNA, 912 bp, Streptococcus thermophilus
atggctgaaaaaattcaattatctcaagcggatcgtaaaaaggtttggtggcgctcacaattcttgcaaggttcatggaactatgaacgtatgcaaaacttgggttgggcttactcactcattcccgctatcaaaaaactttatactaacaaagaggaccaagccgcagctcttaaacgtcacttgaaattcttcaacactcacccttacgtagctgctcctatcatgggggttaccttagctcttgaagaagaaaaagctaatggtactgaaatcgaagatgcagctatccaaggggttaaaatcggtatgatgggtccacttgccggtatcggtgaccctgtcttctggttcacaattcgtccaattcttggtgccattggtgcttcattggcacaagctggtaacattgctggtccacttatcttcttcattggttggaaccttatccgcatggccttcttgtggtacactcaagaacttggttacaaagcaggttcagaaatcactaaagacatgtctggtggtatcttgaaagatattactaaaggggcatcaatacttggtatgttcatcttggccgtcctcgttgaacgttgggtatctgtcgtcttcactgtaaagcttccaggtaaagttttgcctaaaagtgcttatattgaatggccaaaaggatatgttactggtgatcaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaattacaatcatcatcggactctttgtagttggtattgttgcaagcttcttcggaatcatgtaa

SEQ ID NO: 219 - protein, 303 aa, Streptococcus thermophilus
MAEKIQLSQADRKKVWWRSQFLQGSWNYERMQNLGWAYSLIPAIKKLYTNKEDQAAALKRHLKFFNTHPYVAAPIMGVTLALEEEKANGTEIEDAAIQGVKIGMMGPLAGIGDPVFWFTIRPILGAIGASLAQAGNIAGPLIFFIGWNLIRMAFLWYTQELGYKAGSEITKDMSGGILKDITKGASILGMFILAVLVERWVSVVFTVKLPGKVLPKSAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 220 - DNA, 912 bp, Streptococcus thermophilus
atggctgaaaaaattcaattatctcaagcggatcgtaaaaaggtttggtggcgctcacaattcttgcaaggtgcatggaactatgaacgtatgcaaaacttgggttgggcttactcactcattcctgctatcaaaaaactttatactaacaaagaggaccaagccgcagctcttaaacgtcacttggaattcttcaacactcacccttacgtagctgctcctatcatgggggttaccttagctcttgaagaagaaaaagctaatggtactgaaatcgaagatgcggctatccaaggggttaaaatcggtatgatgggtccacttgccggtattggtgaccctgtcttctggttcacaattcgtccaattcttggtgcccttggtgcatcattggcacaagctggtaacattgctggtccacttatcttcttcattggttggaaccttatccgcatggccttcttgtggtacactcaagaacttggttacaaagcaggttcagaaatcactaaagacatgtctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgatcaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 221 - protein, 303 aa, Streptococcus thermophilus
MAEKIQLSQADRKKVWWRSQFLQGAWNYERMQNLGWAYSLIPAIKKLYTNKEDQAAALKRHLEFFNTHPYVAAPIMGVTLALEEEKANGTEIEDAAIQGVKIGMMGPLAGIGDPVFWFTIRPILGALGASLAQAGNIAGPLIFFIGWNLIRMAFLWYTQELGYKAGSEITKDMSGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 222 - DNA, 912 bp, Streptococcus thermophilus
atggctgaaaaaattcaattatctcaagcggatcgtaaaaaggtttggtggcgctcacaattcttgcaaggttcatggaactatgaacgtatgcaaaacttgggttgggcttactcactcattcctgctatcaaaaaactttatactaacaaagaggaccaagccgcagctcttaaacgtcacttgaaattcttcaacactcacccttacgtagctgctcctatcatgggggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgccattggtgcttcattggcacaagctggtaacattgctggtccacttatcttcttcattggttggaaccttatccgcatggtcttcttgtggtacactcaagaacttggttacaaagcaggttcagaaatcactaaagacatgtctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgatcaactaaaaactatccttggtcaagtcaacgataagcttagctttgataatattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 223 - protein, 303 aa, Streptococcus thermophilus
MAEKIQLSQADRKKVWWRSQFLQGSWNYERMQNLGWAYSLIPAIKKLYTNKEDQAAALKRHLKFFNTHPYVAAPIMGVTLALEEEKANGTEIEDAAIQGVKIGMMGPLAGIGDPVFWFTIRPILGAIGASLAQAGNIAGPLIFFIGWNLIRMVFLWYTQELGYKAGSEITKDMSGGILKDITKGASILGMFILAVLVERWVSVVFTVKLPGKVLPKGAYIEWPKGYVTGDQLKTILGQVNDKLSFDNIQVDTLQKQLDSLIPGLTGLLLTFACMWLLKKKVSPITIIIGLFVVGIVASFFGIM

SEQ ID NO: 224 - DNA, 912 bp, Streptococcus thermophilus
atggctgaaaaaattcaattatctcaagcggatcgtaaaaaggtttggtggcgctcacaattcttgcaaggtgcatggaactatgaacgtatgcaaaacttgggttgggcttactcactcattcctgctatcaaaaaactttatactaacaaagaggaccaagccgcagctcttaaacgtcacttggaattcttcaacactcacccttacgtagctgctcctatcatgggggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgcccttggtgcatcattggcacaagctggtaacattgctggtccacttatcttcttcattggttggaaccttatccgcatggccttcttgtggtacactcaagaacttggttacaaagcaggttcagaaatcactaaagacatatctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgaccaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagtttcttcggaatcatgtaa

SEQ ID NO: 225 - protein, 303 aa, Streptococcus thermophilus
MAEKIQLSQADRKKVWWRSQFLQGAWNYERMQNLGWAYSLIPAIKKLYTNKEDQAAALKRHLEFFNTHPYVAAPIMGVTLALEEEKANGTEIEDAAIQGVKIGMMGPLAGIGDPVFWFTIRPILGALGASLAQAGNIAGPLIFFIGWNLIRMAFLWYTQELGYKAGSEITKDISGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 226 - DNA, 912 bp, Streptococcus thermophilus
atgtctgaaaaaattcaattatctcaagcggatcgtaaaaaggtttggtggcgctcacaattcttgcaaggttcatggaactatgaacgtatgcaaaacttgggttgggcttactcactcattcctgctatcaaaaaactttatactaacaaagaggaccaagccgcagctcttaaacgtcacttggaattcttcaacactcacccttacgtagctgctcctatcatgggggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgcccttggtgcatcattggcacaagctggtaacattgctggtccacttatcttcttcattggttggaaccttatccgcatgaccttcttgtggtacactcaagaacttggttacaaagcaggttcagaaatcactaaagacatgtctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgatcaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 227 - protein, 303 aa, Streptococcus thermophilus
MSEKIQLSQADRKKVWWRSQFLQGSWNYERMQNLGWAYSLIPAIKKLYTNKEDQAAALKRHLEFFNTHPYVAAPIMGVTLALEEEKANGTEIEDAAIQGVKIGMMGPLAGIGDPVFWFTIRPILGALGASLAQAGNIAGPLIFFIGWNLIRMTFLWYTQELGYKAGSEITKDMSGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 228 - DNA, 912 bp, Streptococcus thermophilus
atggctgaaaaaattcaattatctcaagcggatcgtagaaaggtttggtggcgctcacaattcttgcaaggttcatggaactatgaacgtatgcaaaacttgggttgggcttactcactcattcctgctatcaaaaaactttatactaacaaagaggaccaagccgcagctcttaaacgtcacttggaattcttcaacactcacccttacgtagctgctcctatcatgggagttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgcccttggtgcatcattggcacaagctggtaacattactggtccacttatcttcttcattggttggaaccttatccgcatggccttcttgtggtacactcaagaacttggttacaaagcaggttcagaaatcactaaagacatgtctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgatcaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 229 - protein, 303 aa, Streptococcus thermophilus
MAEKIQLSQADRRKVWWRSQFLQGSWNYERMQNLGWAYSLIPAIKKLYTNKEDQAAALKRHLEFFNTHPYVAAPIMGVTLALEEEKANGTEIEDAAIQGVKIGMMGPLAGIGDPVFWFTIRPILGALGASLAQAGNITGPLIFFIGWNLIRMAFLWYTQELGYKAGSEITKDMSGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 230 - DNA, 912 bp, Streptococcus thermophilus
atggctgaaaaaattcaattatctcaagcggatcgtagaaaggtttggtggcgcttacaattcttgcaaggttcatggaactatgaacgtatgcaaaacttgggttgggcttactcactcattcctgctatcaaaaaactttatactaacaaagaggaccaagccgcagctcttaaacgtcacttggaattcttcaacactcacccttacgtagctgctcctatcatgggggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgcccttggtgcatcattggcacaagctggtaacattgctggtccacttatcttcttcattggttggaaccttatccgcatggccttcttgtggtacactctagaacttggttacaaagaaggttcagaaatcactaaagacatgtctggtggtatcttgaaagatattactaaaggggcatcaatacttggtatgttcttcttggccgtcctcgttgaacgttgggtatctgtcgtcttcactgtaaagcttccaggtaaagttttgcctaaaggtgcttatattgaatggccaaaaggatatgttactggtgaccaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 231 - protein, 303 aa, Streptococcus thermophilus
MAEKIQLSQADRRKVWWRLQFLQGSWNYERMQNLGWAYSLIPAIKKLYTNKEDQAAALKRHLEFFNTHPYVAAPIMGVTLALEEEKANGTEIEDAAIQGVKIGMMGPLAGIGDPVFWFTIRPILGALGASLAQAGNIAGPLIFFIGWNLIRMAFLWYTLELGYKEGSEITKDMSGGILKDITKGASILGMFFLAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 232 - DNA, 912 bp, Streptococcus thermophilus
atggctgaaaaaattcaattatctcaagcggatcgtaaaaaggtttggtggcgctcacaattcttgcaaggttcatggaactatgaacgtatgcaaaacttgggttgggcttactcactcattcctgctatcaaaaaactttatactaacaaagaggaccaagccgcagctcttaaacgtcacttgaaattcttcaacactcacccttacgtagctgctcctatcatgggggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgccattggtgcttcattggcacaagctggtaacattgctggtccacttatcttcttcattggttggaaccttatccgcatggccttcttgtggtacactcaagaacttggttacaaagcaggttcagaaatcactaaagacatgtctggtggtatcttgaaagatattactaaaggggcatcaatacttggtatgttcatcttggccttcctcgttgaacgttgggtatctgtcgtcttcactgtaaagcttccaggtaaagttttgcctaaaggtgcttatattgaatggccaaaaggatatgttactggtgatcaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 233 - protein, 303 aa, Streptococcus thermophilus
MAEKIQLSQADRKKVWWRSQFLQGSWNYERMQNLGWAYSLIPAIKKLYTNKEDQAAALKRHLKFFNTHPYVAAPIMGVTLALEEEKANGTEIEDAAIQGVKIGMMGPLAGIGDPVFWFTIRPILGAIGASLAQAGNIAGPLIFFIGWNLIRMAFLWYTQELGYKAGSEITKDMSGGILKDITKGASILGMFILAFLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 234 - DNA, 912 bp, Streptococcus thermophilus
atggctgaaaaaattcaattatctcaagcggatcgtaaaaaggtttggtggcgctcacaattcttgcaaggttcatggaactatgaacgtatgcaaaacttgggttgggcttactcactcattcctgctatcaaaaaactttatactaacaaagaggaccaagccgcagctcttaaacgtcacttgaaattcttcaacactcacccttacgtagctgctcctatcatggggattaccttagctcttgaagaagaaaaagctaatggtactgaaatcgaagatgcggctatccaaggggttaaaatcggtatgatgggtccacttgccggtatcggtgaccctgtcttctggttcacaattcgtccaattctaggtgccattggtgcttcattggcacaagctggtaacattgctggtccacttatcttcttcattggttggaaccttatccgcatggccttcttgtggtacactcaagaacttggttacaaagcaggttcagaaatcactaaagacatgtctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgaccaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcactaatcacaatcatcatcggactctttgtagttggtattgttgcaagcttcttcggaatcatgtaa

SEQ ID NO: 235 - protein, 303 aa, Streptococcus thermophilus
MAEKIQLSQADRKKVWWRSQFLQGSWNYERMQNLGWAYSLIPAIKKLYTNKEDQAAALKRHLKFFNTHPYVAAPIMGITLALEEEKANGTEIEDAAIQGVKIGMMGPLAGIGDPVFWFTIRPILGAIGASLAQAGNIAGPLIFFIGWNLIRMAFLWYTQELGYKAGSEITKDMSGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSLITIIIGLFVVGIVASFFGIM

SEQ ID NO: 236 - DNA, 912 bp, Streptococcus thermophilus
atggctgaaaaaattcaattatctcaagcggatcgtagaaaggtttggtggcgctcacaattcttgcaaggttcatggaactatgaacgtatgcaaaacttgggttgggcttactcactcattcctgctatcaaaaaactttatactaacaaagaggatcaagccgcagctcttaaacgtcacttggaattcttcaacactcacccttacgtagctgctcctatcatgggggttaccttagctcttgaagaagaaaaagctaatggtactgaaatcgaagatgcggctatccaaggggttaaaatcggtatgatgggtccccttgcaggtatcggtgaccctgtcttctggttcacaattcgtccaattcttggtgcccttggtgcatcattggcacaagctggtaacattactggtccacttatcttcttcattggttggaaccttatccgcatggccttcttgtggtacactcaagaacttggttacaaatcaggttcagaaatcactaaagacatgtctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgaccaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 237 - protein, 303 aa, Streptococcus thermophilus
MAEKIQLSQADRRKVWWRSQFLQGSWNYERMQNLGWAYSLIPAIKKLYTNKEDQAAALKRHLEFFNTHPYVAAPIMGVTLALEEEKANGTEIEDAAIQGVKIGMMGPLAGIGDPVFWFTIRPILGALGASLAQAGNITGPLIFFIGWNLIRMAFLWYTQELGYKSGSEITKDMSGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 238 - DNA, 912 bp, Streptococcus thermophilus
atggctgaaaaaattcaattatctcaagcggatcgtaaaaaggtttggtggcgctcacaattcttgcaaggtgcatggaactatgaacgtatgcaaaacttgggttgggcttactcactcattcctgctatcaaaaaactttatactaacaaagaggaccaagccgcagctcttaaacgtcacttggaattcttcaacactcacccttacgtagctgctcctatcataggggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgcccttggtgcatcattggcacaatctggtaacattgctggtccacttatcttcttcattggttggaaccttatccgcatgaccttcttgtggtacactcaagaacttggttacaaagcaggttcagaaatcactaaagacatgtctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgaccaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 239 - protein, 303 aa, Streptococcus thermophilus
MAEKIQLSQADRKKVWWRSQFLQGAWNYERMQNLGWAYSLIPAIKKLYTNKEDQAAALKRHLEFFNTHPYVAAPIIGVTLALEEEKANGTEIEDAAIQGVKIGMMGPLAGIGDPVFWFTIRPILGALGASLAQSGNIAGPLIFFIGWNLIRMTFLWYTQELGYKAGSEITKDMSGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 240 - DNA, 912 bp, Streptococcus thermophilus
atgtctgaaaaaattcaattatctcaagcggatcataaaaaggtttggtggcgctcacaattcttgcaaggttcatggaactatgaacgtatgcaaaacttgggttgggcttactcactcattcctgctatcaaaaaactttatactaacaaagaggaccaagccgcagctcttaaacgtcacttggaattcttcaacactcacccttacgtagctgctcctatcatgggggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgcccttggtgcatcattggcacaatctggtaacattgctggtccacttatcttcttcattggttggaaccttatccgcatgaccttcttgtggtacactcaagaacttggttacaaagcaggttcagaaatcactaaagacatgtctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgaccaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 241 - protein, 303 aa, Streptococcus thermophilus
MSEKIQLSQADHKKVWWRSQFLQGSWNYERMQNLGWAYSLIPAIKKLYTNKEDQAAALKRHLEFFNTHPYVAAPIMGVTLALEEEKANGTEIEDAAIQGVKIGMMGPLAGIGDPVFWFTIRPILGALGASLAQSGNIAGPLIFFIGWNLIRMTFLWYTQELGYKAGSEITKDMSGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 242 - DNA, 912 bp, Streptococcus thermophilus
atggctgaaaaaattcaattatctcaagcggatcgtaaaaaggtttggtggcgctcacaattcttgcaaggtgcatggaactatgaacgtatgcaaaacttgggttgggcttactcactcattcctgctatcaaaaaactttatactaacaaagaggaccaagccgcagctcttaaacgtcacttggaattcttcaacactcacccttacgtagctgctcctatcatagaggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgcccttggtgcatcattggcacaagctggtaacattgctggtccacttatcttcttcattggttggaaccttatccgcatggccttcttgtggtacactcaagaacttggttacaaagcaggttcagaaatcactaaagacatatctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgaccaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 243 - protein, 303 aa, Streptococcus thermophilus
MAEKIQLSQADRKKVWWRSQFLQGAWNYERMQNLGWAYSLIPAIKKLYTNKEDQAAALKRHLEFFNTHPYVAAPIIEVTLALEEEKANGTEIEDAAIQGVKIGMMGPLAGIGDPVFWFTIRPILGALGASLAQAGNIAGPLIFFIGWNLIRMAFLWYTQELGYKAGSEITKDISGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 244 - DNA, 912 bp, Streptococcus thermophilus
atggctgaaaaaattcaattatctcaagcggatcgtaaaaaggtttggtggcgctcacaattcttgcaaggtgcatggaactatgaacgtatgcaaaacttgggttgggcttactcactcattcctgctatcaaaaaactttatactaacaaagaggaccaagccgcagctcttaaacgtcacttggaattcttcaacactcacccttacgtagatgctcctatcatgggggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgcccttggtgcatcattggcacaagctggtaacattgctggtccacttatcttcttcattggttggaaccttatccgcatggccttcttgtggtacactcaagaacttggttacaaagcaggttcagaaatcactaaagacatatctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgaccaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagtttcttcggaatcatgtaa

SEQ ID NO: 245 - protein, 303 aa, Streptococcus thermophilus
MAEKIQLSQADRKKVWWRSQFLQGAWNYERMQNLGWAYSLIPAIKKLYTNKEDQAAALKRHLEFFNTHPYVDAPIMGVTLALEEEKANGTEIEDAAIQGVKIGMMGPLAGIGDPVFWFTIRPILGALGASLAQAGNIAGPLIFFIGWNLIRMAFLWYTQELGYKAGSEITKDISGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 246 - DNA, 912 bp, Streptococcus thermophilus
atggctgaaaaaattcaattatctcaagcggatcgtaaaaaggtttggtggcgctcacaattcttgcaaggtgcatggaactatgaacgtatgcaaaacttgggttgggcttactcactcattcctgctatcaaaaaactttatactaacaaagaggaccaagccgcagctcttaaacgtcacttggaattcttcaacactcacccttacgtagctgctcctatcataggggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgcccttggtgcatcattggcacaagctggtaacattgctggtccacttatcttcttcattggttggaaccttatccgcatggccttcttgtggtacactcaagaacttggttacaaagcaggttcagaaatcactaaagacatgtctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgaccaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 247 - protein, 303 aa, Streptococcus thermophilus
MAEKIQLSQADRKKVWWRSQFLQGAWNYERMQNLGWAYSLIPAIKKLYTNKEDQAAALKRHLEFFNTHPYVAAPIIGVTLALEEEKANGTEIEDAAIQGVKIGMMGPLAGIGDPVFWFTIRPILGALGASLAQAGNIAGPLIFFIGWNLIRMAFLWYTQELGYKAGSEITKDMSGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 248 - DNA, 912 bp, Streptococcus thermophilus
atggctgaaaaaattcaattatctcaagcggatcgtagaaaggtttggtggcgctcacaattcttgcaaggttcatggaactatgaacgtatgcaaaacttgggttgggcttactcactcattcctgctatcaaaaaactttatactaacaaagaggatcaagccgcagctcttaaacgtcacttggaattcttcaacactcacccttacgtagctgctcctatcatgggggttaccttagctcttgaagaagaaaaagctaatggtactgaaatcgaagatgcggctatccaaggggttaaaatcggtatgatgggtccacttgcaggtatcggtgaccctgtcttctggttcacaattcgtccaattcttggtgccattggtgcttcattggcacaagctggtaacattgctggtccacttatcttcttcattggttggaaccttatccgcatggccttcttgtggtacactcaagaacttggttacaaatcaggttcagaaatcactaaagacatgtctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgatcaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 249 - protein, 303 aa, Streptococcus thermophilus
MAEKIQLSQADRRKVWWRSQFLQGSWNYERMQNLGWAYSLIPAIKKLYTNKEDQAAALKRHLEFFNTHPYVAAPIMGVTLALEEEKANGTEIEDAAIQGVKIGMMGPLAGIGDPVFWFTIRPILGAIGASLAQAGNIAGPLIFFIGWNLIRMAFLWYTQELGYKSGSEITKDMSGGILKDITKGASILGMFILAVLVERWVSVVFTVKLPGKVLPKGAYIEWPKGYVTGDQLKTILGQVNDKLSFDKIQVDTLQKQLDSLIPGLTGLLLTFACMWLLKKKVSPITIIIGLFVVGIVASFFGIM

SEQ ID NO: 250 - DNA, 913 bp, Streptococcus thermophilus
atggctgaaaaaattcaattatctcaagcggatcgtaaaaaaggtttggtggcgctcacaattcttgcaaggtgcatggaactatgaacgtatgcaaaacttgggttgggcttactcactcattcctgctatcaaaaaactttatactaacaaagaggaccaagccgcagctcttaaacgtcacttggaattcttcaacactcacccttacgtagctgctcctatcataggggttaccttagctcttgaagaagaaaaagctaatggtactgaaatcgaagatgcggctatccaaggggttaaaatcggtatgatgggtccacttgccggtatcggtgaccctgtcttctggttcacaattcgtccaattcttggtgcccttggtgcatcattggcacaagctggtaacattgctggtccacttatcttcttcattggttggaaccttatccgcatggccttcttgtggtacactcaagaacttggttacaaagcaggttcagaaatcactaaagacatatctggtggtatcttgaaagatattactaaaggggcatcaatacttggtatgttcatcttggccgtcctcgttgaacgttgggtatctgtcgtcttcactgtaaagcttccaggtaaagttttgcctaaaggtgcttatattgaatggccaaaaggatatgttactggtgaccaactaaaaactatccttggtcaagtcaacgataagcttagctttgataagattcaagtcgataccctacaaaaacaattggattcattaattccaggtttgacgggacttctccttacttttgcatgtatgtggttgcttaagaagaaagtttcaccaatcacaatcatcatcggactctttgtagttggtattgttgcaagcttcttcggaatcatgtaa

SEQ ID NO: 251 - protein, 28 aa, Streptococcus thermophilus
MAEKIQLSQADRKKGLVALTILARCMEL

SEQ ID NO: 252 - protein, 28 aa, Streptococcus thermophilus
MAEKIQLSQADRKKGLVALTILARFMEL

SEQ ID NO: 253 - protein, 28 aa, Streptococcus thermophilus
MSEKIQLSQADRKKGLVALTILARFMEL

SEQ ID NO: 254 - protein, 28 aa, Streptococcus thermophilus
MAEKIQLSQADRRKGLVALTILARFMEL

SEQ ID NO: 255 - protein, 28 aa, Streptococcus thermophilus
MSEKIQLSQADHKKGLVALTILARFMEL

SEQ ID NO: 256 - DNA, 21 bp, Artificial Sequence
  Oligonucleotide primer
caggtatgagtttagcaacgg

SEQ ID NO: 257 - DNA, 21 bp, Artificial Sequence
  Oligonucleotide primer
agttcaatcttcatcatctcg

SEQ ID NO: 258 - DNA, 20 bp, Artificial Sequence
  Oligonucleotide primer
gtagccacattgttcctgac

SEQ ID NO: 259 - DNA, 20 bp, Artificial Sequence
  Oligonucleotide primer
ttgctgaagctacagtttcc

SEQ ID NO: 260 - DNA, 20 bp, Artificial Sequence
  Oligonucleotide primer
taagcaagactagcagctcc

SEQ ID NO: 261 - DNA, 20 bp, Artificial Sequence
  Oligonucleotide primer
ttgcgtagtcgtgttgaagg

SEQ ID NO: 262 - DNA, 21 bp, Artificial Sequence
  Oligonucleotide primer
attgtcccttcataagcatcg

SEQ ID NO: 263 - DNA, 20 bp, Artificial Sequence
  Oligonucleotide primer
cgaactgggtgcagatgatg

SEQ ID NO: 264 - DNA, 19 bp, Artificial Sequence
  Oligonucleotide primer
attcaccacggcctgagac

SEQ ID NO: 265 - DNA, 20 bp, Artificial Sequence
  Oligonucleotide primer
gaagcagtttggggtagtag

SEQ ID NO: 266 - DNA, 20 bp, Artificial Sequence
  Oligonucleotide primer
gagttatctacaggagctgg

---

The invention claimed is:

1. A lactose-positive, galactose-negative, *Streptococcus thermophilus* strain, wherein:
   the lactose-positive, galactose-negative, *Streptococcus thermophilus* strain has a mutation in the glcK gene;
   the strain exhibits glucokinase activity, and the exhibited glucokinase activity is between 200 and 1500 U/g of total protein extract, as assayed by test A; and
   the strain exhibits a ratio of beta-galactosidase activity as assayed by test D over glucokinase activity as assayed by test E of at least $4 \times 10^{-6}$.

2. The lactose-positive, galactose-negative, *Streptococcus thermophilus* strain according to claim 1, wherein the glucokinase activity in said strain is between 300 and 1200 U/g of total protein extract, as assayed by test A.

3. The lactose-positive, galactose-negative, *Streptococcus thermophilus* strain according to claim 1, wherein the glucokinase activity in said strain is between 10 and 50% of the glucokinase activity of the DGCC7710 strain (deposited at the DSMZ under accession number DSM28255 on Jan. 14, 2014), when both are assayed by test A.

4. The lactose-positive, galactose-negative, *Streptococcus thermophilus* strain according to claim 1, wherein:
   the strain exhibits a glucokinase maximum forward velocity (Vmax); and
   the exhibited glucokinase Vmax is
      defined by one or two of these parameters:
         the glucokinase Vmax in said strain is between 300 and 1200 U/g, as assayed by test C;
         the glucokinase Vmax in said strain is between 10 and 50% of the glucokinase Vmax of the DGCC7710 strain (deposited at the DSMZ under accession number DSM28255 on Jan. 14, 2014), when both are assayed by test C.

5. The lactose-positive, galactose-negative, *Streptococcus thermophilus* strain according to claim 1, wherein the mutated glcK gene codes for a glucokinase having an amino acid at its position 275 which is a lysine.

6. The lactose-positive, galactose-negative, *Streptococcus thermophilus* strain according to claim 1, which is further mutated in the ccpA gene.

7. The lactose-positive, galactose-negative, *Streptococcus thermophilus* strain according to claim 6, wherein the sequence of said mutated ccpA gene is as defined in SEQ ID NO:71.

8. The lactose-positive, galactose-negative, *Streptococcus thermophilus* strain according to claim 1, which is further mutated in the manL gene encoding a protein of the mannose-glucose-specific PTS.

9. The lactose-positive, galactose-negative, *Streptococcus thermophilus* strain according to claim 8, wherein the mutated manL gene encoding a protein of the mannose-glucose-specific PTS codes for a protein having the sequence of the $IIAB^{Man}_{305}$ protein of SEQ ID NO:156.

10. The lactose-positive, galactose-negative, *Streptococcus thermophilus* strain according to claim 1, wherein the *Streptococcus thermophilus* strain is characterized such that a milk fermented with said *Streptococcus thermophilus* strain in accordance with test B achieves a glucose concentration of at least 8 mM.

11. The lactose-positive, galactose-negative, *Streptococcus thermophilus* strain according to claim 1, which is further:
   a) mutated in the lacZ gene encoding a beta-galactosidase such that the lactose hydrolysis activity of said beta-galactosidase is increased, or
   b) mutated in the ptsH gene encoding HPr.

12. A composition, wherein the composition comprises:
   a lactose-positive, galactose-negative, *Streptococcus thermophilus* strain according to claim 1; and
   one or more strain(s) selected from the group consisting of a strain of the *Lactobacillus* genus, a strain of the *Lactococcus* genus, and a strain of the *Bifidobacterium* genus.

13. A method for manufacturing a fermented product, wherein the method comprises:
   inoculating a substrate with the lactose-positive, galactose-negative, *Streptococcus thermophilus* strain according to claim 1, and
   fermenting said inoculated substrate.

14. A method according to claim 13, wherein:
   the fermented product comprises a fermented dairy product, and
   the substrate comprises a milk substrate.

\* \* \* \* \*